(12) United States Patent
Fahrenkrug et al.

(10) Patent No.: US 10,893,667 B2
(45) Date of Patent: *Jan. 19, 2021

(54) NON-MEIOTIC ALLELE INTROGRESSION

(71) Applicant: Recombinetics, Inc., St. Paul, MN (US)

(72) Inventors: Scott C. Fahrenkrug, Minneapolis, MN (US); Daniel F. Carlson, Woodbury, MN (US)

(73) Assignee: Recombinetics, Inc., Eagan, MN (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/567,655

(22) Filed: Sep. 11, 2019

(65) Prior Publication Data

US 2020/0017877 A1 Jan. 16, 2020

Related U.S. Application Data

(60) Continuation of application No. 16/424,356, filed on May 28, 2019, which is a continuation-in-part of application No. 15/802,272, filed on Nov. 2, 2017, which is a division of application No. 14/625,797, filed on Feb. 19, 2015, now abandoned, which is a continuation of application No. 14/263,446, filed on Apr. 28, 2014, now Pat. No. 9,528,124, said application No. 16/424,356 is a continuation-in-part of application No. 13/404,662, filed on Feb. 24, 2012, now abandoned, said application No. 16/424,356 is a continuation-in-part of application No. 13/594,694, filed on Aug. 24, 2012, now abandoned, which is a continuation-in-part of application No. 13/404,662, filed on Feb. 24, 2012, now abandoned, said application No. 16/424,356 is a continuation-in-part of application No. 14/067,634, filed on Oct. 30, 2013, now abandoned, said application No. 16/424,356 is a continuation-in-part of application No. 14/154,906, filed on Jan. 14, 2014, now abandoned.

(60) Provisional application No. 61/870,401, filed on Aug. 27, 2013, provisional application No. 61/446,651, filed on Feb. 25, 2011, provisional application No. 61/662,767, filed on Jun. 21, 2012, provisional application No. 61/870,510, filed on Aug. 27, 2013, provisional application No. 61/720,187, filed on Oct. 30, 2012, provisional application No. 61/752,232, filed on Jan. 14, 2013, provisional application No. 61/870,570, filed on Aug. 27, 2013.

(51) Int. Cl.
| | |
|---|---|
| *A01K 67/00* | (2006.01) |
| *A01K 67/027* | (2006.01) |
| *C12N 15/85* | (2006.01) |
| *C12N 15/90* | (2006.01) |
| *C07K 14/715* | (2006.01) |
| *C07K 14/47* | (2006.01) |
| *C12N 15/877* | (2010.01) |

(52) U.S. Cl.
CPC .......... *A01K 67/0275* (2013.01); *C07K 14/47* (2013.01); *C07K 14/715* (2013.01); *C12N 15/85* (2013.01); *C12N 15/8509* (2013.01); *C12N 15/8771* (2013.01); *C12N 15/8778* (2013.01); *C12N 15/90* (2013.01); *C12N 15/902* (2013.01); *C12N 15/907* (2013.01); *A01K 2227/101* (2013.01); *A01K 2227/102* (2013.01); *A01K 2227/103* (2013.01); *A01K 2227/107* (2013.01); *A01K 2227/40* (2013.01); *C12N 2750/14143* (2013.01); *C12N 2800/30* (2013.01); *C12N 2800/90* (2013.01)

(58) Field of Classification Search
CPC .............. C12N 15/8509; C12N 15/902; C12N 2800/80; A01K 67/0275; A01K 2217/072; A01K 2227/101–103; A01K 2227/107; A01K 2227/108; A01K 2227/40
See application file for complete search history.

(56) References Cited

U.S. PATENT DOCUMENTS

| | | |
|---|---|---|
| 3,100,448 A | 8/1963 | Hablutzel |
| 3,174,527 A | 3/1965 | Reed et al. |
| (Continued) | | |

FOREIGN PATENT DOCUMENTS

| | | |
|---|---|---|
| CN | 1484707 A | 3/2004 |
| CN | 1970749 A | 5/2007 |
| (Continued) | | |

OTHER PUBLICATIONS

Google Breed definition. Printed from Google search on Mar. 12, 2020.pp. 1-2 (Year: 2020).*

(Continued)

*Primary Examiner* — Marcia S Noble
(74) *Attorney, Agent, or Firm* — Wilson Sonsini Goodrich & Rosati

(57) ABSTRACT

Methods, uses, and compositions for manipulating genomic DNA. Some of the embodiments of the invention provide for making a founder animal that is completely free of all unplanned genetic modifications. Some embodiments are directed to removing genetic faults in established breeds without making other alterations to the genome. Other embodiments are directed to particular tools or processes such as TALENs or CRISPR with a preferred truncation. One embodiment involves introducing a targeted targeting endonuclease system and a HDR template into a cell (optionally with a mismatch in the binding of the targeting endonuclease and the targeted site). Another embodiment includes processes of making a genetically modified livestock animal comprising a genome that comprises inactivation of a neuroendocrine gene selective for sexual maturation, with the inactivation of the gene preventing the animal from becoming sexually mature. One embodiment includes compositions and methods for making livestock with a polled allele, including migrating a polled allele into a *bovine* species without changing other genes or chromosomal portions.

22 Claims, 87 Drawing Sheets
Specification includes a Sequence Listing.

(56) References Cited

U.S. PATENT DOCUMENTS

| | | |
|---|---|---|
| 3,395,549 A | 8/1968 | Grimes |
| 3,548,741 A | 12/1970 | Ronald |
| 3,586,526 A | 6/1971 | Elihu et al. |
| 3,613,752 A | 10/1971 | Earl, Jr. |
| 3,653,466 A | 4/1972 | Hiroshi et al. |
| 3,697,359 A | 10/1972 | William, Jr. et al. |
| 3,740,793 A | 6/1973 | Crawford et al. |
| 3,833,240 A | 9/1974 | Weiler |
| 4,873,191 A | 10/1989 | Wagner et al. |
| 4,888,274 A | 12/1989 | Radding et al. |
| 5,142,047 A | 8/1992 | Summerton et al. |
| 5,185,444 A | 2/1993 | Summerton et al. |
| 5,239,060 A | 8/1993 | Kunkel et al. |
| 5,430,129 A | 7/1995 | Campbell et al. |
| 5,510,473 A | 4/1996 | Camerini-Otero et al. |
| 5,521,071 A | 5/1996 | Attie et al. |
| 5,610,053 A | 3/1997 | Chung et al. |
| 5,674,992 A | 10/1997 | Jagendorf et al. |
| 5,731,178 A | 3/1998 | Sippel et al. |
| 5,731,411 A | 3/1998 | Voloshin et al. |
| 5,763,240 A | 6/1998 | Zarling et al. |
| 5,798,209 A | 8/1998 | Chan |
| 5,948,653 A | 9/1999 | Pati et al. |
| 5,985,846 A | 11/1999 | Kochanek et al. |
| 6,100,448 A | 8/2000 | Thompson et al. |
| 6,174,527 B1 | 1/2001 | Wilson et al. |
| 6,388,169 B1 | 5/2002 | Mahajan et al. |
| 6,395,549 B1 | 5/2002 | Tuan et al. |
| 6,541,684 B1 | 4/2003 | Bowen et al. |
| 6,548,741 B2 | 4/2003 | Desousa et al. |
| 6,586,251 B2 | 7/2003 | Economides et al. |
| 6,613,752 B2 | 9/2003 | Kay et al. |
| 6,653,466 B2 | 11/2003 | Matsuo |
| 6,686,515 B1 | 2/2004 | Lassner et al. |
| 6,720,478 B1 | 4/2004 | Mahajan et al. |
| 6,740,793 B2 | 5/2004 | Michaeli |
| 6,774,213 B1 | 8/2004 | Roca |
| 6,809,183 B2 | 10/2004 | Mahajan |
| 6,833,240 B2 | 12/2004 | Engert et al. |
| 6,905,857 B2 | 6/2005 | Bowen et al. |
| 7,008,776 B1 | 3/2006 | Jaye et al. |
| 7,034,117 B2 | 4/2006 | Mahajan et al. |
| 7,144,734 B2 | 12/2006 | Court et al. |
| 7,176,007 B2 | 2/2007 | Cox et al. |
| 7,199,281 B2 | 4/2007 | Murray et al. |
| 7,294,494 B2 | 11/2007 | Roca |
| 7,306,794 B2 | 12/2007 | Wilson et al. |
| 7,323,337 B2 | 1/2008 | Hanazono et al. |
| 7,361,641 B2 | 4/2008 | Calos et al. |
| 7,416,849 B2 | 8/2008 | Allen et al. |
| 7,429,690 B2 | 9/2008 | Robl et al. |
| 7,510,867 B2 | 3/2009 | Xiao |
| 7,709,206 B2 | 5/2010 | Denise et al. |
| 7,732,585 B2 | 6/2010 | Calos et al. |
| 7,795,493 B2 | 9/2010 | Phelps et al. |
| 7,820,878 B2 | 10/2010 | Goldsby et al. |
| 7,972,783 B2 | 7/2011 | Denise et al. |
| 8,440,432 B2 | 5/2013 | Voytas et al. |
| 8,470,973 B2 | 6/2013 | Bonas et al. |
| 8,518,701 B2 | 8/2013 | Fahrenkrug et al. |
| 8,536,363 B2 | 9/2013 | Phares et al. |
| 8,546,643 B2 | 10/2013 | Bentzon et al. |
| 8,586,526 B2 | 11/2013 | Gregory et al. |
| 8,697,359 B1 | 4/2014 | Zhang |
| 10,058,078 B2 | 8/2018 | Carlson et al. |
| 2001/0016315 A1 | 8/2001 | Renaville et al. |
| 2002/0155446 A1 | 10/2002 | Engert et al. |
| 2003/0017534 A1 | 1/2003 | Buelow et al. |
| 2003/0232410 A1 | 12/2003 | Liljedahl et al. |
| 2004/0038362 A1 | 2/2004 | Wei et al. |
| 2004/0088745 A1 | 5/2004 | Robl et al. |
| 2004/0203158 A1 | 10/2004 | Hackett et al. |
| 2005/0003542 A1 | 1/2005 | Kay et al. |
| 2005/0153317 A1 | 7/2005 | Denise et al. |
| 2005/0176665 A1 | 8/2005 | McSwiggen |
| 2006/0263354 A1 | 11/2006 | Chin et al. |
| 2007/0254296 A1 | 11/2007 | Jiang et al. |
| 2008/0188000 A1 | 8/2008 | Reik et al. |
| 2009/0241203 A1 | 9/2009 | Welsh et al. |
| 2010/0105140 A1 | 4/2010 | Fahrenkrug et al. |
| 2010/0138939 A1 | 6/2010 | Bentzon et al. |
| 2010/0146655 A1 | 6/2010 | Fahrenkrug et al. |
| 2010/0160417 A1 | 6/2010 | Lawrence et al. |
| 2011/0023140 A1 | 1/2011 | Bedell et al. |
| 2011/0023158 A1 | 1/2011 | Bedell et al. |
| 2011/0059160 A1 | 3/2011 | Essner et al. |
| 2011/0145940 A1 | 6/2011 | Voytas et al. |
| 2011/0197290 A1 | 8/2011 | Fahrenkrug et al. |
| 2011/0201118 A1 | 8/2011 | Yang et al. |
| 2011/0207221 A1 | 8/2011 | Cost et al. |
| 2011/0262909 A1 | 10/2011 | Cargill et al. |
| 2011/0287545 A1 | 11/2011 | Cost et al. |
| 2011/0301073 A1 | 12/2011 | Gregory et al. |
| 2012/0030778 A1 | 2/2012 | Weinstein et al. |
| 2012/0149115 A1 | 6/2012 | Kim et al. |
| 2012/0192298 A1 | 7/2012 | Weinstein et al. |
| 2012/0196370 A1 | 8/2012 | Urnov et al. |
| 2012/0222143 A1 | 8/2012 | Fahrenkrug et al. |
| 2013/0117870 A1 | 5/2013 | Fahrenkrug et al. |
| 2013/0198878 A1 | 8/2013 | Doyon et al. |
| 2013/0203870 A1 | 8/2013 | Rogers et al. |
| 2013/0212723 A1 | 8/2013 | West |
| 2013/0212725 A1 | 8/2013 | Kuehn et al. |
| 2013/0217131 A1 | 8/2013 | Kim et al. |
| 2013/0298268 A1 | 11/2013 | West |
| 2013/0326645 A1 | 12/2013 | Cost et al. |
| 2014/0014066 A1 | 1/2014 | Yacoub |
| 2014/0041066 A1 | 2/2014 | Carlson et al. |
| 2014/0120612 A1 | 5/2014 | Doyon et al. |
| 2014/0123330 A1 | 5/2014 | Carlson et al. |
| 2014/0201857 A1 | 7/2014 | Fahrenkrug et al. |
| 2014/0220575 A1 | 8/2014 | Hayes et al. |
| 2014/0301990 A1 | 10/2014 | Gregory et al. |
| 2015/0071889 A1 | 3/2015 | Musunuru et al. |
| 2016/0273000 A1 | 9/2016 | Fahrenkrug et al. |
| 2018/0051298 A1 | 2/2018 | Fahrenkrug et al. |
| 2019/0106708 A1 | 4/2019 | Fahrenkrug et al. |

FOREIGN PATENT DOCUMENTS

| | | |
|---|---|---|
| CN | 101014715 A | 8/2007 |
| CN | 101389214 A | 3/2009 |
| EP | 0196879 A2 | 10/1986 |
| JP | 2011229456 A | 11/2011 |
| WO | WO-9902667 A1 | 1/1999 |
| WO | WO-0212437 A2 | 2/2002 |
| WO | WO-2004022748 A1 | 3/2004 |
| WO | WO-2006036975 A2 | 4/2006 |
| WO | WO-2006116269 A2 | 11/2006 |
| WO | WO-2008106892 A1 | 9/2008 |
| WO | WO-2008106982 A2 | 9/2008 |
| WO | WO-2009085689 A2 | 7/2009 |
| WO | WO-2010014857 A2 | 2/2010 |
| WO | WO-2010021692 A1 | 2/2010 |
| WO | WO-2010079430 A1 | 7/2010 |
| WO | WO-2010143917 A2 | 12/2010 |
| WO | WO-2011002988 A1 | 1/2011 |
| WO | WO-2011011767 A1 | 1/2011 |
| WO | WO-2011017315 A2 | 2/2011 |
| WO | WO-2011019385 A1 | 2/2011 |
| WO | WO-2011072246 A2 | 6/2011 |
| WO | WO-2011078665 A1 | 6/2011 |
| WO | WO-2011100058 A1 | 8/2011 |
| WO | WO-2011146121 A1 | 11/2011 |
| WO | WO-2011154393 A1 | 12/2011 |
| WO | WO-2012012738 A1 | 1/2012 |
| WO | WO-2012021632 A2 | 2/2012 |
| WO | WO-2012116274 A2 | 8/2012 |
| WO | WO-2012152912 A1 | 11/2012 |
| WO | WO-2012168304 A1 | 12/2012 |
| WO | WO-2012168307 A2 | 12/2012 |
| WO | WO-2013088446 A1 | 6/2013 |

(56) References Cited

FOREIGN PATENT DOCUMENTS

| WO | WO-2013191769 A1 | 12/2013 |
|---|---|---|
| WO | WO-2014189680 A1 | 11/2014 |
| WO | WO-2015060732 A1 | 4/2015 |

OTHER PUBLICATIONS

EP18199895.6 Extended European Search Report dated Jan. 5, 2019.
EP18204730.8 Extended European Search Report dated Feb. 11, 2019.
U.S. Appl. No. 13/404,662 Office Action dated Aug. 27, 2018.
U.S. Appl. No. 13/404,662 Restriction Requirement dated Oct. 9, 2014.
U.S. Appl. No. 13/594,694 Office Action dated Feb. 27, 2019.
U.S. Appl. No. 13/594,694 Restriction Requirement dated Oct. 28, 2014.
U.S. Appl. No. 14/460,841 Office Action dated Oct. 12, 2018.
U.S. Appl. No. 15/085,398 Office Action dated May 17, 2018.
Aboussekhra et al, Semidominant Suppressors of Srs2 Helicase Mutations of *Saccharomyces cerevisiae* Map in the RAD51 Gene, Whose Sequence Predicts a Protein with Similarities to procaryotic RecA Proteins. Molecular and Cellular Biology, 12.7 (Jul. 1992): 3224-3234.
Advisory Action dated Mar. 2, 2016 from U.S. Appl. No. 13/404,662, 4 Pages.
Advisory Action dated Mar. 31, 2016 from U.S. Appl. No. 13/594,694, 7 Pages.
Advisory Action dated May 3, 2016 from U.S. Appl. No. 14/154,906, 3 Pages.
Ahn, et al. The structural and functional diversity of dystrophin. Nat Genet. Apr. 1993;3(4):283-91.
Aiello et al., Apolipoprotein B and a second major gene locus contribute to phenotypic variation of spontaneous hypercholesterolemia in pigs, Arterioscler Thromb Vasc Biol 14 (1994): 409-419.
Alexander et al., A Limousin Specific Myostatin Allele Affects Longissimus Muscle Area and Fatty Acid Profiles in a Wagyu-Limousin F2 Population, Journal of Animal Science, 87 (Dec. 5, 2014): 1576-1581.
Allais-Bonnet et al, Novel Insights into the Bovine Polled Phenotype and Horn Ontogenesis Bovidae. PLoS DNE, 8.5 (May 2013): 1-14.
Amendment After Final dated Jan. 28, 2018 from U.S. Appl. No. 13/404,662, 35 Pages.
Amendment After Final dated Apr. 27, 2016 from U.S. Appl. No. 14/154,906, 30 Pages.
Amendment After Final dated Jan. 12, 2018 from U.S. Appl. No. 13/594,694, 23 Pages.
Amendment After Final dated Nov. 22, 2017 from U.S. Appl. No. 14/154,906, 13 Pages.
Amendment dated Apr. 24, 2017 from U.S. Appl. No. 13/594,694, 29 Pages.
Amendment dated May 31, 2016 from U.S. Appl. No. 13/594,694, 44 Pages.
Amendment dated Apr. 19, 2017 from U.S. Appl. No. 13/404,662, 46 Pages.
Amendment dated Apr. 27, 2017 from U.S. Appl. No. 14/154,906, 67 Pages.
Amendment dated Feb. 26, 2016 from U.S. Appl. No. 13/404,662, 83 Pages.
Amendment dated Mar. 28, 2016 from U.S. Appl. No. 13/594,694, 134 Pages.
Amendment dated Oct. 1, 2015 from U.S. Appl. No. 13/404,662, 19 Pages.
Amendment dated Oct. 8, 2015 from U.S. Appl. No. 13/594,694, 54 Pages.
Amendment dated Sep. 17, 2015 from U.S. Appl. No. 14/154,906, 14 Pages.
Appeal Brief dated Mar. 4, 2016 from U.S. Appl. No. 13/025,373, 81 Pages.
Ausubel, et al. Short Protocols in Molecular Biology, Wiley & Sons, 1999, Unit 7.7, pp. 7-58 to 7-63.
Babayev et al, Gene Therapy: Correction of Genetic Information, Education Learning Materials for Advanced Training Program. Storage and Processing of Information in Biological Systems, Nizhny Novgorod, 2007, 9 Pages.
Banki et al, Cloning and Expression of the Human Gene for Transaldolase. The Journal of Biochemical Journal, 269.4 (Jan. 28, 1994): 2847-2851.
Banks et al., Functional capacity of dystrophins carrying deletions in the N-terminal actin-binding domain, Hum Mol Genet, 16.17 (2007): 2105-2113.
Banks et al., Neuromuscular synapses mediate motor axon branching and motoneuron survival during the embryonic period of programmed cell death. Developmental biology, 257 (2003): 71-84.
Bannister et al., TALENs Mediate Efficient and Heritable Mutation of Endogenous Genes in the Marine Annelid Platynereis Dumerilii, Genetics, 197 (May 2014): 77-89.
Bar et al., A novel product of the Duchenne muscular dystrophy gene which greatly differs from the known isoforms in its structure and tissue distribution. The Biochemical journal, 272 (1990): 557-560.
Barnea et al., Specificity of expression of the muscle and brain dystrophin gene promoters in muscle and brain cells. Neuron, 5 (1990): 881-888.
Barzon et al., Gene Therapy of Thyroid Cancer Via Retrovirally-Driven Combined Expression of Human Interleukin-2 and Herpes Simplex Virus Thymidine Kinase. European Journal of Endocrinology, 148 (2003): 73-80.
Basile et al, Nucleotide Sequence and Transcriptional Regulation of the Yeast Recombinational Repair Gene RAD51. Molecular and Cellular Biology, 12.7 (Jul. 1992): 3235-3246.
Bedell, et al. In vivo genome editing using a high-efficiency TALEN. Nature. 491.7422 (2012): 114-118.
Beg et al. Embryonic lethality and liver degeneration in mice lacking the RelA component of NF-kappa B. Nature 376:167-170 (1995).
Beggs et al., Exploring the molecular basis for variability among patients with Becker muscular dystrophy: dystrophin gene and protein studies. Am J Hum Genet, 49 (1991): 54-67.
Bell et al, Histopathological changes in Duchenne muscular dystrophy. J Neurol Sci, 7 (1968): 529-544.
Benavides et al. The hairless mouse in skin research. J. Derm. Sci., 53 (2009): 10-18.
Bernstein, Exercise assessment of transgenic models of human cardiovascular disease. Physiol Genomics 13.3 (2003): 217-226.
Beurdeley et al. Compact designer TALENs for efficient genome engineering. Nat Commun 4:1762 (2013), 8 pages.
Blake et al, Function and Genetics of Dystrophin and Dystrophin-Related Proteins in Muscle. Physiol Rev, 82 (2002): 291-329.
Boch et al. Breaking the Code of DNA Binding Specificity of TAL-Type III Effectors. Science 326:1509-1512 (Dec. 11, 2009).
Boch, TALEs of Genome Targeting Nature Biotechnology, 29.2 (Feb. 2011): 135-136.
Bogdanove et al, TAL Effectors: Customizable Proteins for DNA Targeting, Science, 333 (Sep. 30, 2011): 1843-1846.
Boyce et al., Dystrophin is transcribed in brain from a distant upstream promoter. Proc Natl Acad Sci USA, 88 (1991): 1276-1280.
Branda et al.,Talking about a Revolution: The Impact of Site-Specific Recombinases on Genetic Analysis in Mice. Dev. Cell, 6 (2004): 7-28.
Brandl et al, Creation of Targeted Genornic Deletions Using TALEN or CRISPR/Cas Nuclease Pairs in One-Cell Mouse Embryos, Federation of European Biochemical Societies, 5 (2015): 26-35.
Breeding for Polledness, SBTS TechTalk, (Nov. 2013): 4 Pages.
Brown et al, How LDL Receptors Influence Cholesterol and Atherosclerosis. Scientific American 251 (1984): 58-66.
Byers et al., An alternative dystrophin transcript specific to peripheral nerve. Nature genetics, 4 (1993): 77-81.
Campbell., Three muscular dystrophies: loss of cytoskeleton-extracellular matrix linkage. Cell, 80 (1995): 675-679.

(56) References Cited

OTHER PUBLICATIONS

Carbery et al, Targeted Genome Modification in Mice Using Zinc-Finger Nucleases. Genetics Society of America, 186 (2010): 451-459.
Carlson (Transgenic Res., Jan. 9, 2011, p. 1-13).
Carlson et al., 328 Versatile Transcription Activator-Like Effector Nuclease (TALEN)-Mediated Engineering of Ossabaw Miniature Swine. Reproduction, Fertility and Development, 25.1 (Dec. 4, 2012): 312. Abstract Only.
Carlson et al., Adding and Subtracting Livestock Genes With Transposons and Nucleases. Transgenic Res, 21.4 (Aug. 2012): 901-902.
Carlson et al., Editing Livestock Genomes With Site-Specific Nucleases. Reproduction, Fertility and Development, 26 (Dec. 5, 2013): 74-82.
Carlson et al., Efficient TALEN-Mediated Gene Knockout in Livestock. Proceeding of the National Academy of Sciences, 109.43 (Oct. 23, 2012): 17382-17387.
Carlson et al., Strategies for Selection Marker-Free Swine Transgenesis Using the Sleeping Beauty Transposon System, Supplementary Data. Transgenic Research (Jan. 9, 2011). 9 pages.
Carlson et al., Strategies for Selection Marker-Free Swine Transgenesis Using the Sleeping Beauty Transposon System. Transgenic Research, Jan. 9, 2011, 13 Pages.
Carlson et al., Targeting DNA with Fingers and TALENs. Molecular Therapy-Nucleic Acid, 1 (2012): 1-5.
Carlson., "Declaration of Dr. Daniel F. Carlson. Aug. 2015.".
Carlson., "Declaration of Dr. Daniel F. Carlson. Oct. 2013.".
Casas et al., Quantitative Trait Loci Affecting Growth and Carcass Composition of Cattle Segregating Alternate forms of Myostatin. Journal of Animal Science, 78 (2000): 560-569.
Cassuto et al, Partial Purification of an Activity From Human Cells that Promotes Homologous Pairing and the Formation of Heteroduplex DNA in the Presence of ATP. Molecular and General Genetics, 208 (1987): 10-14.
Cermak, et al. Efficient design and assembly of custom TALEN and other TAL effector-based constructs for DNA targeting. Nucleic Acids Res. 39.12 (Jul. 2011): e82. doi: 10.1093/nar/gkr218. Epub Apr. 14, 2011.
Chamberlain et al, Dystrophin-deficient mdx mice display a reduced life span and are susceptible to spontaneous rhabdomyosarcoma. FASEB J, 21 (2007): 2195-2204.
Chang et al., CRISPR/cas9, A Novel Genomic Tool to Knock Down MicroRNA in vitro and in vivo. Scientific Reports (Feb. 29, 2016): 12 Pages.
Charreau et al., Transgenesis in rats: technical aspects and models. Transgenic Res 5 (1996): 223-234.
Chelly et al, Effect of dystrophin gene deletions on mRNA levels and processing in Duchenne and Becker muscular dystrophies. Cell, 63 (1990): 1239-1248.
Chen et al, High-Frequency Genome Editing Using ssDNA Oligonucleotides With Zinc-Finger Nucleases. Nature Methods Advance Online Publication Published Online Jul. 17, 2011. 32 pages. DOI: 10.1038/NMETH.1653.
Chetboul et al, Tissue Doppler assessment of diastolic and systolic alterations of radial and longitudinal left ventricular motions in Golden Retrievers during the preclinical phase of cardiomyopathy associated with muscular Dystrophy. American Journal of Veterinary Research, 65 (2004): 1335-1341.
Chetboul et al., Tissue Doppler imaging detects early asymptomatic myocardial abnormalities in a dog model of Duchenne's cardiomyopathy. European heart journal, 25 (2004): 1934-1939.
Childers et al., Eccentric contraction injury in dystrophic canine muscle. Archives of physical medicine and rehabilitation, 83 (2002): 1572-1578.
Christian, et al. Targeting DNA double-strand breaks with TAL effector nucleases. Genetics.186 (2010): 757-761.
Cibelli, et al. Cloned transgenic calves produced from nonquiescent fetal fibroblasts. Science, 280 (1998):1256-1258.
Clark et al, A TALE of Two Nucleases: Gene Targeting for the Masses? Minireview, 8.3 (2011): 147-149.

Clark et al, Enzymatic Engineering of the Porcine Genome with Transposons and Recombinases. BMC Biotechnology, 7.42 (Jul. 17, 2007): 1-17.
Clark et al., Isolation, DNA Sequence, and Regulation of *Saccharomyces cerevisiae* Gene That Encode DNA Strand Transfer Protein alpha. Molecular and Cellular Biology, 11.5 (May 1991): 2576-2582.
Clark et al., Pigs taking wing with Transposons and Recombinases, Genome Biology, 8 (Suppl 1), (Oct. 31, 2007): S13-S13.16.
Cogoni et al., Gene Silencing in Neurospora crassa Requires a Protein Homologous to RNA- Dependent RNA Polymerase. Nature 399 (May 13, 1999): 166-169.
Cogoni et al., Transgene Silencing of the al-1 Gene in Vegetative Cells of Neurospora in Mediated by a Cytoplasmic Effector and Does Not Depend on DNA-DNA interactions or DNA Methylation. The EMBO Journal. 15.12 (1996): 3153-3163.
Coleman et al. Of mouse and man—what is the value of the mouse in predicting gene expression in humans? Drug Discov Today 8(6) (Mar. 2003): 233-235.
Cooper et al., Mosaic expression of dystrophin in carriers of canine X-linked muscular dystrophy. Laboratory investigation; A journal of technical methods and pathology, 62.2 (1990): 171-178.
Cooper, et al. The homologue of the Duchenne locus is defective in X-linked muscular dystrophy of dogs. Nature. Jul. 14, 1988;334(6178):154-6.
Co-pending U.S. Appl. No. 16/424,356, filed May 28, 2019.
Co-pending U.S. Appl. No. 16/552,974, filed Aug. 27, 2019.
Co-pending U.S. Appl. No. 16/567,682, filed Sep. 11, 2019.
Cox et al., Dp71 can restore the dystrophin-associated glycoprotein complex in muscle but fails to prevent dystrophy. Nature genetics, 8 (1994): 333-339.
Cox, Historical Overview: Searching for Replication Help in all of the Rec Places Proceedings of the National Academy of Science, 98.15 (Jul. 17, 2001): 8173-8180.
Cox, Recombinational DNA Repair in Bacteria and the RecA Protein. Progress in Nucleic Acid Research and Molecular Biology, 63 (2000): 311-366.
Cui et al., RecA-mediated, Targeted Mutagenesis in Zebrafish Marine Biotechnology, 5 (2003): 174-184.
Dai, et al. Targeted disruption of the alpha 1,3-galactosyltransferase gene in cloned pigs. Nat Biotechnol. 20.3 (Mar. 2002): 251-5.
Daugherty., Mouse models of atherosclerosis. American Journal of Medical Science; 323.1 (2002): 3-10.
Davis et al., Targeted Disruption of LDLR Causes Hypercholesterolemia and Atherosclerosis in Yucatan Miniature Jigs. PLOS One, 9.4 (Apr. 2014): 11 Pages.
Deconinck et al., Utrophin-dystrophin-deficient mice as a model for Duchenne muscular dystrophy, Cell, 90 (1997): 717-727.
Definition of Epigenetic Variation From Expert Glossary dated Jan. 25, 2018, 2 Pages.
Denning et al, Deletion of the a(1,3) Galactosyl Transferase (GGTA1) Gene and the Prion Protein (PrP) Gene in Sheep. Nature Biotechnology, 19 (Jun. 2001): 559-562.
Description of LDLR gene. Wikipedia, 2017.
Doetschman, Influence of Genetic Background on Genetically Engineered Mouse Phenotypes. Methods in Molecular Biology, 530 (2009): 423-433.
Dong et al, Heritable Targeted Inactivation of Myostatin Gene in Yellow Catfish (Pelteobagrus Fulvidraco) Using Engineered Zinc Finger Nucleases. PLoS One, 6.12 (Dec. 2011): p. e28897.
Doyon et al., Transient Cold Shock Enhances Zinc-Finger Nuclease-Mediated Gene Disruption. Nature Methods 7.6 (Jun. 2010): 459-461.
Doyon, et al. Heritable targeted gene disruption in zebrafish using designed zinc-finger nucleases. Nat Biotechnol. 26.6 (Jun. 2008): 702-8. doi: 10.1038/nbt1409. Epub May 25, 2008.
D'Souza et al., A novel dystrophin isoform is required for normal retinal electrophysiology. Hum Mol Genet, 4 (1995): 837-842.
Dunderdale et al., Formation and Resolution of Recombination Intermediates by *E. coli* RecA and RuvC Proteins. Nature, 354.19 (Dec. 26, 1991): 506-10.

(56) References Cited

OTHER PUBLICATIONS

Dupuy et al., Mammalian Germ-Line Transgenesis by Transposition Proceeding of the National Academy of Sciences, 99.7 (2002): 4495-4499.
Dykstra et al. Cloning and Characterization of DST2, the Gene for DNA Strand Transfer Protein I From *Saccharomyces cervisiae*. Molecular and Cellular Biology, 11.5 (May 1991): 2583-2592.
Eisen et al., A Recombinase from *Drosophila melanogaster* Embryos. Proceeding of the National Academy of Sciences, 85 (Oct. 1988): 7481-7485.
Eisener-Dorman et al, Cautionary Insights on Knockout Mouse Studies: The Gene or Not the Gene?. Brain, Behavior, and Immunity Journal 23.3 (Mar. 2009): 318-324.
EP11742838.3 Supplementary European Search Report dated Dec. 17, 2013.
EP11742838.3 Supplementary European Search Report dated Nov. 25, 2013.
EP12749281.7 Office Action dated Feb. 29, 2016.
EP12749281.7 Office Action dated Jul. 27, 2015.
EP12749281.7 Office Action dated Oct. 6, 2016.
EP12749281.7 Result of Consultation dated Apr. 11, 2018.
EP12749281.7 Result of Consultation dated Mar. 23, 2018.
EP12749281.7 Summons to Attend Oral Proceedings dated Oct. 4, 2017.
EP13806511.5 Office Action dated Apr. 3, 2017.
EP13806511.5 Office Action dated Apr. 4, 2018.
Ervasti et al, Deficiency of a glycoprotein component of the dystrophin complex in dystrophic muscle. Nature, 345 (1990): 315-319.
European search report with written opinion dated Feb. 5, 2016 for EP Application No. 13806511.
European search report with written opinion dated Oct. 27, 2014 for EP Application No. 12749281.
Examinees Answer dated Sep. 28, 2016 from U.S. Appl. No. 13/025,373, 20 Pages.
Fahrenkrug et al., 95 Production of Gene-Edited Pigs, Cattle, and Lambs by Embryo Injection of TALENS or 1FNs. Reproduction, Fertility and Development, 26.1 (Dec. 5, 2013): 161. Abstract Only.
Fahrenkrug et al., Precision Genetics for Complex Objectives in Animal Agriculture. Journal of Animal Science, 88 (2010): 2530-2539.
Fahrenkrug., Reproduction, Fertility and Development. 26.1 (2014): 161.
Farzadfard et al, Tunable and Multifunctional Eukaryotic Transcription Factors Based on CRISPR/Cas, ACS Synthetic Biology, 2 (2013): 604-613.
Fattori et al, Drug-eluting stents in vascular intervention, Lancet 361 (2003): 247-249.
File History for U.S. Appl. No. 13/025,373, filed Feb. 11, 2011; entitled Methods and Materials for 3roducing Transgenic Artiodactyls; from Feb. 11, 2011 to Nov. 28, 2016; 340 pages.
Fire et al. Potent and specific genetic interference by double-stranded RNA in Caenorhabditis elegans. Nature 391 (1998): 806-811.
Fishel et al., Identification of Homologous Pairing and Strand-Exchange Activity From a human Tumor Cell Line Based on Z-DNA Affinity Chromatography. Proceeding of the National Academy of Sciences, 85 (1988): 36-40.
Flisikowska et al. Efficient Immunoglobulin Gene Disruption and Targeted Replacement in Rabbit Using Zinc Finger Nucleases. PLoS ONE 6(6):e21045 (Jun. 2011). 10 pages.
Fok et al. Multiplexed CRISPR/Cas9 genome editing increases the efficacy of homologous-dependent repair of donor sequences in mammalian cells. South African Journal of Science 111(7-8):1-7 (Jul./Aug. 2015).
Ganea et al., Characterization of an ATP-Dependent DNA Strand Transferase from Human Cells. Molecular and Cellular Biology, 7.9 (1987): 3124-3130.
Garrels et al, Recent Progress of Transgenic Pig Models for Biomedicine and Pharmaceutical Research. Newsletter, 36 (2011): 17-23.
GenBank Accession No. AF065990 (May 27, 1998). Retrieved Feb. 25, 2014 at URL: <http://www.ncbi.nlm.nih.gov/nuccore/AF065990>.
GenBank accession No. JH115025.1 (submitted Aug. 24, 2011).
Gene Polymorphism Wikipedia, Jan. 26, 2018, 6 Pages.
Genetic mutations are part of cloning process, scientists find LA Times, Sep. 2, 2002.
Genetic Mutations Are Part of Cloning Process, Scientists Find, LA Times, Sep. 13, 2002, 3 Pages.
Georges et al, Microsatellite Mapping of a Gene Affecting Horn Development in Bos Taurus. Nature Genetics, 4 (Jun. 1993): 206-210.
Geurts et al, Knockout Rats Produced Using Designed Zinc Finger Nucleases, Science, 325 (Jul. 24, 2009), p. 433.
Glass et al, Atherosclerosis. the road ahead. Cell, 104 (2001): 503-516.
GOH CRISPR—What Can Go Wrong and How to Deal With It, Http://Blog.Sitoolsbiotech.corn/author/cati, Apr. 11, 2017, 7 pages.
Gonzalez-Recio, Epigenetics: A New Challenge in the Post-Genomic Era of Livestock. Frontiers in Genetics, 2 (Jan. 2012): 1-4.
Google search for "hdr template" retrieved Mar. 3, 2016 at URL<https://www.google.com/>. 2 pages.
Gorecki et al, Expression of four alternative dystrophin transcripts in brain regions regulated by different promoters. Human Molecular Genetics, 1.7 (1992): 505-510.
Grady et al., Skeletal and cardiac myopathies in mice lacking utrophin and dystrophin: a model for Duchenne muscular dystrophy. Cell, 90 (1997): 729-738.
Grainger et al., Apolipoprotein E modulates clearance of apoptotic bodies in vitro and in vivo, resulting in a systemic proinflammatory state in apolipoprotein E-deficient mice. J Immunol 173 (2004): 6366-6375.
Greenberg et al., Exogenous Dp71 restores the levels of dystrophin associated proteins but does not alleviate muscle damage in mdx mice. Nature genetics, 8 (1994): 340-344.
Greenberg et al., Reduced levels of dystrophin associated proteins in the brains of mice deficient for Dp71. Hum Mol Genet, 5.9 (1996): 1299-1303.
Grisham., Interspecies comparison of liver carcinogenesis: implications for cancer risk assessment. Carcinogenesis 18.1 (1996): 59-81.
Grobet et al., A Deletion in the Bovine Myostatin Gene Causes the Double-Muscled Phenotype in Cattle, Nature Genetics, 17 (Sep. 17, 1997), p. 71.
Grobet et al., Molecular Definition of an Allelic Series of Mutations Disrupting the Myostatin Function and 2,ausing Double-Muscling in Cattle. Mammalian Genome, 9 (1998): 210-213.
Grobet et al., Molecular definition of an allelic series of mutations disrupting the myostatin function and causing double-muscling in cattle. Mammalian Genome, 9 (1998): 210-213.
Grunwald et al., Identification of a novel Arg—>Cys mutation in the LDL receptor that contributes to spontaneous hypercholesterolemia in pigs. J Lipid Res, 40 (1999): 475-485.
Guatelli et al. Isothermal, in vitro amplification of nucleic acids by a multienzyme reaction modeled after retroviral replication. PNAS USA 87(5):1874-1878 (1990).
Guschin, et al. A rapid and general assay for monitoring endogenous gene modification. Methods Mol Biol. 649 (2010): 247-56. doi: 10.1007/978-1-60761-753-2_15.
Halbrook et al., Purification and Characterization of DNA-Pairing and Strand Transfer Activity from Mitotic *Saccharomyces cerevisiae*. The Journal of Biological Chemistry, 264.35 (Dec. 15, 1989): 21403-21412.
Hann et al., Building 'validated' mouse models of human cancer. Curr Opin Cell Biol, 13 (2001): 778-784.
Harris, Towards an ovine model of cystic fibrosis. Hum Mol Genet, 6.13 (1997): 2191-2193.

(56) References Cited

OTHER PUBLICATIONS

Hasler-Rapacz et al., Identification of a mutation in the low density lipoprotein receptor gene associated with Recessive familial hypercholesterolemia in swine. American Journal Medical Genetics, 76 (1998): 379-386.
Hasler-Rapacz et al., Sus Scrofa Low Density Lipoprotein Receptor (LDLR) mRicds GenBank, Dec. 6, 1999, 2 Pages.
Hauschild et al., Efficient Generation of a Biallelic Knockout in Pigs Using Zinc-Fingers Nucleases. Proceedings of the National Academy of Sciences, 108 (2011): 12013-12017.
Hendrickson., "Declaration of Dr. Eric A. Hendrickson. Jun. 2015.".
Henwood et al., Lovastatin. A preliminary review of its pharmacodynamic properties and therapeutic use in hyperlipidaemia. Drugs 36 (1988): 429-454.
High., Gene therapy: the moving finger. Nature, 435 (2005): 577-579.
Hirata et al. Targeted transgene insertion into human chromosomes by adeno-associated virus vectors. Nature Biotechnology 20 (2002): 735-738.
Hirata et al., Efficient PRNP gene targeting in bovine fibroblasts by adena-associated virus vectors. Cloning and Stem Cells, 6.1 (2004): 31-36.
Hirst, Cattle (Bos Spp)—History of the Domestication of Cows and Yaks, How Cattle Came to Be Domesticated Perhaps Four Times!, ThoughtCo.corn, Updated Apr. 19, 2017, 6 Pages.
Hirst, Linearbandkerarnik Culture—European Farming Innovators, ThoughtCo, Updated Mar. 8, 2017, 3 Pages.
Hodges et al., Generation of Bovine Transgenics Using Somatci Cell Nuclear Transfer, Reproductive Biology and Endocrinology, 1.81 (Nov. 7, 2003): 1-7.
Holmes Jr. et al., Results of Prevention of REStenosis with Tranilast and its Outcomes (PRESTO) trial Circulation. Journal of the American Heart Association, 106 (2002): 1243-1250.
Hsieh et al., Formation of Joint DNA Molecules by Two Eukaryotic Strand Exchange Proteins Does Not Require Melting of a DNA Duplex. The Journal of Biological Chemistry, 264.9 (Mar. 25, 1989): 5089-5097.
Huang et al., Heritable Gene Targeting in Zebrafish Using Customized TALENs. Nature Biotechnology, 29.8 (Aug. 2011): 699-700.
Hyrup, et al. Peptide Nucleic Acids (PNA): Synthesis, Properties and Potential Applications. Bioorg. Med. 4.1 (1996): 5-23.
Ishibashi et al. Hypercholesterolemia in Low Density Lipoprotein Receptor Knockout Mice and its Reversal by Adenovirus-mediated Gene Delivery. J. Clin Invest., 92 (Aug. 1993): 883-893.
Janus et al., Transgenic mouse models of Alzheimer's disease. Physiol Behav, 73 (2001): 873-886.
Jinek et al. RNA-programmed genome editing in human cells. elife 2 (2013): e00471.
Jung et al., Identification and characterization of the dystrophin anchoring site on beta-dystroglycan. The Journal of Biological Chemistry, 270.45 (1995): 27305-27310.
Kambadur et al., Mutations in Myostatin (GDF8) in Double-Muscled Belgian Blue and Piedmontese Cattle. Genome Res., 7 (1997): 910-915.
Kawakami, Tol2: a versatile gene transfer vector in vertebrates. Genome Biology, 8(suppl 1) article s7, S7.1-S7.10 (2007).
Kennerdell et al., Use of dsRNA-Mediated Genetic Interference to Demonstrate that frizzled and frizzled 2 Act in the Wingless Pathway. Cell, 95 (Dec. 23, 1998): 1017-1026.
Kim et al., Targeted Genome Editing in Human Cells with Zinc Finger Nucleases Constructed via Modular Assembly. Genome Research, 19 (2009): 1279-1288.
Kiwaki et al., Correction of Ornithine Transcarbamylase Deficiency in Adult spfash Mice and in OTC-Deficient Human Hepatocytes with Recombinant Adenoviruses Bearing the CAG Promoter. Human Gene Therapy, 7 (May 1, 1996): 821-830.
Koenig, et al. The complete sequence of dystrophin predicts a rod-shaped cytoskeletal protein. Cell. Apr. 22, 1988; 53(2): 219-28.

Kohila et al., Evaluation of the effects of aluminium, ethanol and their combination on rat brain synaptosomal integral proteins in vitro and after 90-day oral exposure, Arch Toxicol, 78 (2004): 276-282.
Kolber-Simonds et al., Production of $\alpha$-1,3-galactosyltransferase null pigs by means of nuclear transfer with fibroblasts bearing loss of heterozygosity mutations, Proc Natl Acad Sci USA; 101.19 (2004): 7335-7340.
Kolodner et al, Purification and Characterization of an Activity from *Saccharomyces cerevisiae* that Catalyzes Homologous Pairing and Strand Exchange. Proceedings of the National Academy of Science, 84 (Aug. 1987): 5560-5564.
Kuehn., Current Status of Genotyping and Discovery Work at USMARC, USMARC Genotyping and Discovery. (Jun. 2010): 2 Pages.
Kuivenhoven et al., The role of a common variant of the cholesteryl ester transfer protein gene in the progression of coronary atherosclerosis, N Engl J Med; 338.2 (1998): 86-93.
Kuroiwa et al., Sequential Targeting of the Genes Encoding immunoglobulin-$\mu$ and Prion Protein in Cattle. Nature Genetics, 36.7 (Jul. 2004): 775-780.
Kuzniar et al., The Quest for Orthologs: Finding the Corresponding Gene Across Genomes. Cell Press, 24 (Nov. 2008): 539-551. Abstract Only.
Lafont, The Cypher stent: no longer efficacious at three months in the porcine model?, Cardiovasc Res; 63, (2004): 575-576.
Lai, et al. Production of alpha-1,3-galactosyltransferase knockout pigs by nuclear transfer cloning. Science. 295.5557 (Feb. 8, 2002): 1089-92. Epub Jan. 3, 2002.
Lavitrano et al., Efficient Production by Sperm-Mediated Gene Transfer of Human Decay Accelerating Factor (hDAF) Transgenic Pigs for Xenotransplantation, Proceedings of the National Academy of Science, 99.22 (Oct. 29, 2002): 14230-14235.
Lavitrano et al., Sperm-Mediated Gene Transfer, Reproduction, Fertility and Development, 18 (2006): 19-23.
Law et al., Dystrophin deficiency is associated with myotendinous junction defects in prenecrotic and fully regenerated skeletal muscle. Am J Pathol, 142.5 (1993): 1513-1523.
Le et al., Monoclonal antibodies against the muscle-specific N-terminus of dystrophin: characterization of dystrophin in a muscular dystrophy patient with a frameshift deletion of exons 3-7, Am J Hum Genet, 53 (1993): 131-139.
Le Provost et al., Zinc Finger Nuclease Technology Heralds a New Era in Mammalian Transgenesis. Trends in Biotechnology, 28.3 (Mar. 2010): 134-141. Available online Dec. 16, 2009. DOI: https://doi.org/10.1016/j.tibtech.2009.11.007.
Leaver, A family of Tc1-like transposons from the genomes of fishes and frogs: evidence for horizontal transmission, Gene, 271 (2001): 203-214.
Lederfein et al., A 71-kilodalton protein is a major product of the Duchenne muscular dystrophy gene in brain and other nonmuscle tissues. Proc Natl Acad Sci U S A, 89 (1992): 5346-5350.
Lee et al, Targeted Chromosomal Deletions in Human Cells Using Zinc Finger Nucleases. Genome Research, 20 (Dec. 1, 2009): 81-89.
Lee et al., Concentrations and compositions of plasma lipoprotein subfractions of Lpb5-Lpu1 homozygous and heterozygous swine with hypercholesterolemia, J Lipid Res; 31 (1990): 839-847.
Leibovitz et al., Exogenous Dp71 is a dominant negative competitor of dystrophin in skeletal muscle, Neuromuscul Disord, 12 (2002): 836-844.
Leroy et al., Methods to Estimate Effective Population Size Using Pedigree Data: Examples in Dog, Sheep, Cattle and Horse. Genetics Selection Evolution, 45.1 (2013): 10 Pages.
Li et al. In vivo genome editing restores haemostasis in a mouse model of haemophilia. Nature 475.7355 (2011): 217-221, plus Supplemental Material.
Li et al. TAL Nucleases (TALNs): Hybrid Proteins Composed of TAL Effectors and FOKL DNA-Cleavage Domain. Nucleic Acids Research, 39.1 (Aug. 10, 2010): 359-372.
Li et al., Improved Isolation and Culture of Embryonic Stem Cells from Chinese Miniature Pig, Journal of Reproduction and Development, vol. 50.2 (2004): 237-244.

(56) References Cited

OTHER PUBLICATIONS

Li et al., Production of a Reporter Transgenic Pig for Monitoring Cre Recombinase Activity Biochemical and Biophysical Research Communications, 382 (2009): 232-235.
Liao et al., Use of RecA Fusion Proteins to Induce Genomic Modifications in Zebrafish. Nucleic Acids Research, (2011): 14 Pages.
Lidov et al., Dp140: a novel 140 kDa CNS transcript from the dystrophin locus, Hum Mol Genet, 4.3 (1995): 329-335.
Lillico et al., Live Pigs Produced From Genome Edited Zygotes, Scientific Reports 3:2847 (Oct. 10, 2013): 4 pages.
Lo, Animal models of human disease. Transgenic and knockout models of autoimmunity: Building a better disease?, Clin Immunol Immunopathol; 79.2 (1996): 96-104.
Lo. Transformation by iontophoretic microinjection of DNA: multiple integrations without tandem insertions. Mol. Cell. Biol., 3.10 (1983): 1803-1814.
Lowe et al., Defective receptor binding of low density lipoprotein from pigs possessing mutant apolipoprotein B alleles, J Biol Chem; 263.30 (1988): 15467-15473.
Lowenhaupt et al., *Drosophila melanogaster* Strand Transferase. The Journal of Biological Chemistry, 264.34 (Dec. 5, 1989): 20568-20575.
Lusis et al., The Problem of Passenger Genes in Transgenic Mice. Arteriosclerosis, Thrombosis, and Vascular Biology, 27 (Aug. 9, 2007): 2100-2103.
Lyons et al., Structure and function of the neuromuscular junction in young adult mdx mice, J Neurocytology, 20 (1991): 969-981.
Ma et al., High Efficiency In Vivo Genome Engineering with a Simplified 15-RVD GoldyTALEN Design. PLOS One, 8.5 (May 2013): 1-8.
Madiraju et al., Properties of a Mutant recA-encoded Protein Reveal a Possible Role for *Escherichia coli* recF-encoded Protein in Genetic Recombination. Proceedings of the National Academy of Science, 85 (Sep. 1988): 6592-6596.
Maeshima et al., RAD51 Homologues in Xenopus laevis: Two Distinct Genes are Highly Expressed in Ovary and Testis. Gene, 160 (1995): 195-200.
Mahley et al., An electrophoretic method for the quantitative isolation of human and swine plasma lipoproteins. Biochemistry 13.9 (1974):1964-1968.
Mali et al., RNA-Guided Human Genome Engineering Via Cas9. Science, (Jan. 3, 2013): 5 Pages.
Malik et al., Acute platelet inhibition with abciximab does not reduce in-stent restenosis., Circulation. J Am Heart Assoc. 102 (2000): e110 (Abstract Only).
Marx, Building better mouse models for studying cancer. Science, 299 (2003): 1972-1975.
Marz et al., Safety of low-density lipoprotein cholesterol reduction with atorvastatin versus simvastatin in a coronary heart disease population (the TARGET TANGIBLE trial). Am J Cardiol, 84 (1999): 7-13.
Mashimo et al, Generation of Knockout Rats with X-linked Severe Combined Immunodeficiency (X-SCID) Using Zinc-Finger Nucleases. PLoS One, 5.1, Jan. 2010.
Matsumura et al., Immunohistochemical analysis of dystrophin-associated proteins in BeckerlDuchenne muscular dystrophy with huge in-frame deletions in the NH2-terminal and rod domains of dystrophin. The Journal of clinical investigation, 93 (1994): 99-105.
McCarthy et al., Sensitive Homologous Recombination Strand-Transfer Assay: Partial Purification of a *Drosophila melanogaster* Enzyme and Detection of Sequence Effects on the Strand-Transfer Activity of RecA Protein Proceeding of the National Academy of Sciences 85 (Aug. 1988): 5854-5858.
McFadden et al., Late thrombosis in drug-eluting coronary stents after discontinuation of antiplatelet therapy. Lancet, 364 (2004): 1519-1521.
McGrew et al., Molecular Design and Functional Organization of the RecA Protein. Critical Reviews in Biochemistry Molecular Biology. 38 (2003): 385-432.
McIntyre et al., Design and Cloning Strategies for Constructing shRNA Expression Vectors. BMC Biotechnology, 6.1 (Jan. 5, 2006): 8 Pages.
McPherron et al., Double Muscling in Cattle Due to Mutations in the Myostatin Gene. Proceeding of the gational Academy of Science, 94 (Nov. 1997): 12457-12461.
McPherson et al, Cerivastatin versus branded pravastatin in the treatment of primary hypercholesterolemia in primary care practice in Canada: a one-year, open-label, randomized, comparative study of efficacy, safety, and cost-effectiveness. Clin Ther, 23.9 (2001): 1492-1507.
Medugorac et al., Bovine Polledness—Autosomal Dominant Trait with Allelic Heterogeneity. PLoS One, 7 .6 (Jun. 2012): 1-11.
Mehlhop, et al. Allergen-induced bronchial hyperreactivity and eosinophilic inflammation occur in the absence of IgE in a mouse model of asthma. Proc Natl Acad Sci U S A. Feb. 18, 1997;94(4):1344-9.
Mehta et al., Deletion of LOX-1 reduces atherogenesis in LDLR knockout mice fed high cholesterol diet. Circulation Research, 100 (2007): 1634-1642.
Mendicino, et al. Generation of antibody- and B cell-deficient pigs by targeted disruption of the J-region gene segment of the heavy chain locus. Transgenic Res. Jun. 2011;20(3):625-41. doi: 10.1007/s11248-010-9444-z. Epub Sep. 26, 2010.
Meng et al., Targeted gene inactivation in zebrafish using engineered zinc finger nucleases. Nat. Biotechnol., 26.6 (Jun. 2008): 695-701.
Meyer et al., Modeling Disease Mutations by Gene Targeting in One-Cell Mouse Embryos. Proceeding of the National Academy of Science, 109.24 (Jun. 12, 2012): 9354-9359.
Miller et al. A TALE nuclease architecture for efficient genome editing. Nat Biotechnol. 29.2 (Feb. 2011): 143-8. doi: 10.1038/nbt.1755. Epub Dec. 22, 2010.
Miller et al. A TALE nuclease architecture for efficient genome editing. Supplementary Information (59 pages). Nat Biotechnol. 29.2 (Feb. 2011): 143-8. doi: 10.1038/nbt.1755. Epub Dec. 22, 2010.
Miskey et al., The Ancient Mariner Sails Again: Transposition of the Human Hsmarl Element by a Reconstructed Transposase and Activities of the SETMAR Protein on Transposon Ends. Molecular and Cellular Biology, 27.12 (Jun. 2007): 4589-4600.
Miskey et al., The Frog Prince: a reconstructed transposon from Rana pipiens with high transpositional activity in vertebrate cells. Nucleic Acids Res. 31.23 (2003): 6873-6881.
Misquitta et al, Targeted Disruption of Gene Function in *Drosophila* by RNA Interference (RNA-i): A Role for Nautilus in Embryonic Somatic Muscle Formation. Proceedings of the National Academy of Science, 96 (Feb. 1999): 1451-1456.
Mistra Biotech, Breeding Genetically Modified Animals for Food Production—Symposium Summary. Swedish University of Agricultural Sciences, 3 Pages.
Moer et al., Stenting in small coronary arteries (SISCA) trial. A randomized comparison between balloon angioplasty and the heparin-coated beStent. J Am Coll Cardiol, 38.6 (2001): 1598-1603.
Moore et al., Purification and Characterization of a Protein from Human Cells Which Promotes Homologous Pairing of DNA. The Journal of Biological Chemistry, 265.19 (Jul. 5, 1990): 11108-11117.
Moore et al., The Human Homologous Pairing Protein HPP-1 is Specifically Stimulated by the Cognate Single-Stranded Binding Protein hRP-A. Proceedings of the National Academy of Science, 88 (Oct. 1991): 9067-9071.
Morita et al., A Mouse Homolog of the *Escherichia coli* recA and *Saccharomyces cerevisiae* RAD51 Genes. Proceedings of the National Academy of Science, 90 (Jul. 1993): 6577-6580.
Moscou, et al. A simple cipher governs DNA recognition by TAL effectors. Science. Dec. 11, 2009;326(5959):1501.
Muni et al., Problems with drug-eluting coronary stents—the FDA perspective. N Engl J Med. 351.16 (2004): 1593-1595.
Muntoni et al., Deletions in the 5' region of dystrophin and resulting phenotypes. Journal of Medical Genetics, 31 (1994): 843-847.

(56) References Cited

OTHER PUBLICATIONS

Mussolino et al., A Novel TALE Nuclease Scaffold Enables High Genome Editing Activity in Combination With Low Toxicity. Nucleic Acids Research, 39.21 (Jul. 5, 2011): 9283-9293.
Nguyen et al, Muscle Lesions Associated with Dystrophin Deficiency in Neonatal Golden Retriever Puppies. Journal of Comparative Pathology. 126 (2002): 100-108.
Nishiyama et al., A Glycine-Rich RNA-Binding Protein Mediating Cold-Inducible Suppression of Mammalian Cell Growth. Journal of Cell Biology, 137.4 (May 19, 1997): 899-908.
Novakovic et al., Proximal Dystrophin Gene Deletions and protein Alterations in Becker Muscular Dystrophy. Annals of the New York Academy of Sciences, 1048 (2005): 406-410.
Nudel et al., Duchenne muscular dystrophy gene product is not identical in muscle and brain. Nature, 337 (1989): 76-78.
Orban et al., Tissue and Site-Specific DNA Recombination in Transgenic Mice. Proceedings of the National Academy of Science, 89 (Aug. 1992): 6861-6865.
Orban et al., Tissue and site-specific DNA recombination in transgenic mice. Proc. Natl. Acad. Sci. USA, 89 (1992): 3861-6865.
Osborn et al. TALEN-based Gene Correction for Epidermolysis Bullosa. Molecular Therapy 21(6):1151-1159 (Jun. 2013).
Ott et al., Genetic Linkage Analysis in the Age of Whole-Genome Sequencing. Nature Reviews, 16 (May 2015): 275-284.
Ozawa et al., Dystrophin-associated proteins in muscular dystrophy. Hum Mol Genet, 4 (1995): 1711-1716.
Paix et al. High Efficiency, Homology-Directed Genome Editing in Caenorhabditis elegans Using CRISPR-Cas9 Ribonucleoprotein Complexes. Genetics 201(1):47-54 (Sep. 2015). Published online Jul. 17, 2015. DOI: https://doi.org/10.1534/genetics.115.179382..
Palgrave et al., Species-Specific Variation in RELA Underlies Differences in NF-KB Activity: A Potential Role in African Swine Fever Pathogenesis. Journal of Virology, 85.12 (Jun. 2011): 6008-6014.
Partridge, Models of dystrophinopathy, pathological mechanisms and assessment of therapies. Cambridge University Press, Cambridge, 1997, 310-331.
Pavlopoulos et al., The DNA transposon Minos as a tool for transgenesis and functional genomic analysis in vertebrates and invertebrates. Genome biology 8.1 (suppl 1) article S2 (2007): S2.1-S2.7.
PCT/US2011/024455 International Search Report and Written Opinion dated Oct. 25, 2011, 10 pages.
PCT/US2012/026500 International Preliminary Report on Patentability dated Aug. 27, 2013.
PCT/US2012/026500 International Search Report and Written Opinion dated Nov. 1, 2012, 11 pages.
PCT/US2013/046590 International Search Report and Written Opinion dated Feb. 5, 2016.
PCT/US2013/046590 International Search Report and Written Opinion dated Sep. 24, 2013, 6 pages.
PCT/US2013/046590 International Preliminary Report on Patentability dated Dec. 23, 2014.
Perez., et al., "Establishment of HIV-1 Resistance in CD4+ T Cells by Genome Editing using Zinc-Finger Nucleases,"Nat. Biotechnol. 26.7 (2008): 808-816.
PhysOrg. CRISPR Gene Editing Can Cause Hundred of Unintended Mutations. Bioethics.com (May 29, 2017). Retrieved Apr. 23, 2018 from URL:<http://www.bioethics.com/archives/38708>. One page.
Piedrahita, Targeted modification of the domestic animal genome, Theriogenology; 53 (2000): 105-116.
Porteus, et al., Gene targeting using zinc finger nucleases—Semantic Scholar. Nature Biotech., 23.8 (2005): 967-973.
Prescott et al., Development of Complex Atherosclerotic Lesions in Pigs with Inherited Hyper-LDL Cholesterolemia Bearing Mutant Alleles for Apolipoprotein. B, Am J Pathol, 139.1 (1991): 139-147.
Prior et al., A missense mutation in the dystrophin gene in a Duchenne muscular dystrophy patient, Nature Genetics, 4 (1993): 357-360.
Proudfoot et al., Genome Edited Sheep and Cattle, Transgenic Research, 24 (Sep. 10, 2015): 147-153.
PubMed Central (PMC) Search for "hdr template" retrieved Mar. 3, 2016 at URL:<http://www.ncbi.nlm.nih.gov/pmc/?term=%22hdr_template%22>. 3 pages.
Purchas et al., Composition and Quality Differences Between the Longissimus and Infraspinatus Muscles for Several Groups of Pasture-Finished Cattle. Meat Science, 80 (Jan. 21, 2008): 470-479.
Ramirez., Unexpected failure rates for modular assembly of engineered zinc fingers. Nature Methods, 5.5 (2008): 374-375.
Ramsoondar, et al. Targeted disruption of the porcine immunoglobulin kappa light chain locus. Transgenic Res. Jun. 2011;20(3):643-53. doi: 10.1007/s11248-010-9445-y. Epub Sep. 26, 2010.
Rapacz et al., Lipoprotein mutations in pigs are associated with elevated plasma cholesterol and atherosclerosis. Science; 234.4783 (1986): 1573-1577.
Rapaport et al., Characterization and cell type distribution of a novel, major transcript of the Duchenne muscular dystrophy gene. Differentiation, 49 (1992): 187-193.
Reiss et al., RecA protein stimulates homologous recombination in plants. Proceedings of the National Academy of Sciences, 93 (Apr. 1996): 3094-3098.
Reiss et al., RecA stimulates sister chromatid exchange and the fidelity of double-strand break repair, but not gene targeting in plants transformed by Agrobacterium. Proceedings of the National Academy of Sciences, 97.7 (Mar. 28, 2000): 3358-3363.
Richt et al. Production of cattle lacking prion protein. Nature Biotechnology 25:132-138 (2007). Published online Dec. 31, 2006. doi: 10.1038/nbt1271.
Robbins, Backcrossing, Backcross (BC) Populations, and Backcross Breeding, Plant Breeding and Genomics, Feb. 1, 2012, 2 Pages.
Roca et al., The RecA Protein: Structure and Function. Biochemistry and Molecular Biology, 25.6 (1990): 415-456.
Rogers et al., Production of CFTR-Null and CFTR-ΔF508 Heterozygous Pigs by Adeno-Associated Virus-Mediated Gene Targeting and Somatic Cell Nuclear Transfer. The Journal of Clinical Investigation, 118 (Apr. 2008): 1571-1577.
Rogers, et al. Disruption of the CFTR Gene Produces a Model of Cystic Fibrosis in Newborn Pigs. Science. Sep. 26, 2008;321(5897):1837-41. doi: 10.1126/science.1163600.
Romano et al, Quelling: transient inactivation of gene expression in Neurospora crassa by transformation with homologous sequences. Mol. Microbiol., 6.22 (1992): 3343-3353.
Rosenfeld et al, Prevention of Hepatic Apoptosis and Embryonic Lethality in RelA1TNFR-1 Double Knockout Vlice. American Journal of Pathology, 156.3 (Mar. 2000): 997-1007.
Ruof et al., Lipid-Lowering Medication for Secondary Prevention of Coronary Heart Disease in a German Outpatient Population: The Gap Between Treatment Guidelines and Real Life Treatment Patterns. Prey Med 35 (2002): 48-53.
Rybakova et al., Dystrophin and Utrophin Bind Actin Through Distinct Modes of Contact. The Journal of Biological Chemistry, 281.15 (2006): 9996-10001.
Sander et al., Engineering Zinc Finger Nucleases for Targeted Mutagenesis of Zebrafish, Methods in Cell Biology, 104 Chapter 3 (2011): 51-58.
Sanjana et al. A transcription activator-like effector toolbox for genome engineering. Nature Protocols 7:171-192 (2012).
Schatzberg et al., Alternative Dystrophin Gene Transcripts in Golden Retriever Muscular Dystrophy. Muscle & Nerve, 21 (1998): 991-998.
Schatzberg et al., Molecular analysis of a spontaneous dystrophin 'knockout' dog. Neuromuscul Disord, 9 (1999): 289-295.
Serruys et al., A Comparison of Balloon-Expandable-Stent Implantation with Balloon Angioplasty in Patients with Coronary Artery Disease. N Engl J Med; 331.8 (1994): 489-495.
Serruys et al., Periprocedural quantitative coronary angiography after Palmaz-Schatz stent implantation predicts :he restenosis rate at six months. Results of a meta-analysis of the Belgian Netherlands Stent study (BENESTENT) I, 3ENESTENT II Pilot, Benestent II and MUSIC trials. J Am Coll Cardiol, 34.4 (1999): 1067-1074.

(56) References Cited

OTHER PUBLICATIONS

Shcherbakova et al., Overexpression of bacterial RecA protein stimulates homologous recombination in somatic mammalian cells, Mutat Res, 459 (2000): 65-71.
Shimatsu et al., Canine X-linked muscular dystrophy in Japan (CXMDJ) Experimental animals / Japanese Association for Laboratory Animal Science, 52.2 (2003): 93-97.
Shinohara et al., Cloning of Human, Mouse and Fission Yeast Recombination Genes Homologous to RAD51 and recA. Nature Genetics, 4 (Jul. 1993): 239-345.
Slater, Structural determinants of the reliability of synaptic transmission at the vertebrate neuromuscular junction. 1 Neurocytol, 32 (2003): 505-522.
SNP Genotyping Wikipedia, Jan. 23, 2018, 10 pages.
Specht., Polled Holstein History, Department of Dairy and Animal Science (2008): 32 pages.
Sugino et al., ATP-Independent DNA Strand Transfer Catalyzed by Protein(s) From Meiotic Cells of the Yeast *Saccharomyces cerevisiae*. Proceedings National Academy of Science, 85 (Jun. 1985): 3683-3687.
Summerton, et al. Morpholino antisense oligomers: design, preparation, and properties. Antisense Nucleic Acid Drug Dev. Jun. 1997;7(3):187-95.
Sus scrofa NF-kappaB transcription factor p65 subunit mRNA, complete cds. Database EMBL (online). Jan. 29, 2008. Retrieved from EBI accession No. EM_STD:EU399817. Database accession No. EU399817.
Suzuki et al., Glycoprotein-binding site of dystrophin is confined to the cysteine-rich domain and the first half of the carboxy-terminal domain. FEBS Letters, 308.2 (1992): 154-160.
Takahashi et al., Characterization of Zebrafish Rad52 and Replication Protein A for Oligonucleotide-mediated Mutagenesis. Nucleic Acids Research, 33.13 (Aug. 1, 2005): 9 Pages.
Takeshima et al, Amino-terminal deletion of 53% of dystrophin results in an intermediate Duchenne-Becker muscular dystrophy phenotype. Neurology, 44 (1994): 1648-1651.
TALEN definition, Wikipedia 2015.
Tan (Transgenic Res., Aug. 2012, vol. 21, No. 4, p. 917, Meeting date Aug. 7-10, 2011).
Tan (Transgenic Res., Feb. 2014, vol. 23, No. 1, p. 202).
Tan et al., Efficient Nonmeiotic Allele Introgression in Livestock Using Custom Endonucleases. Proceeding of the National Academy of Sciences. (Aug. 13, 2013): 6 pages.
Tan et al., Efficient Non-meiotic Allele Introgression in Livestock Using Custom Endonucleases. Supplementary Information Appendix. Proceeding of the National Academy of Sciences. (Aug. 13, 2013). 26 pages.
Tan, et al. Precision editing of large animal genomes. Adv Genet. 2012;80:37-97. doi: 10.1016/B978-0-12-404742-6.00002-8.
Tan, Genome Engineering in Large Animals for Agricultural and Biomedical Applications, A Dissertation Submitted to the Faculty of University of Minnesota (Aug. 2013).
Teglund et al. Breeding genetically modified animals for food production—symposium summary. Swedish University of Agriculture Sciences (Jun. 24, 2014). 3 pages.
Tesson et al, Knockout Rats Generated by Embryo Microinjection of TALENs. Nature Biotechnology, 29.8 (Aug. 2011): 695-696.
Thompson, et al. Germ line transmission and expression of a corrected HPRT gene produced by gene targeting in embryonic stem cells. Cell, 56 (1989):313-321.
Thompson, Hairless is a nuclear receptor corepressor essential for skin function. Nucl Recept Signal, 7 (2009): 1-11.
Tishkoff et al., Molecular and Genetic Analysis of the Gene Encoding the *Saccharomyces cerevisiae* Strand Exchange Protein Sept. Molecular and Cellular Biology, 11.5 (May 1991): 2593-2608.
Topol et al, Outcomes at 1 year and economic implications of platelet glycoprotein IIb/IIIa blockade in patients undergoing coronary stenting: results from a multicentre randomised trial, Lancet; 354 (1999): 2019-2024.
Transcription Activator-Like Effector Nuclease Information, 2015, 6 pages.
U.S. Appl. No. 13/404,662 Office Action dated Apr. 3, 2015.
U.S. Appl. No. 13/404,662, filed Feb. 24, 2012, patent prosecution history.
U.S. Appl. No. 13/594,694, filed Aug. 24, 2012, patent prosecution history.
U.S. Appl. No. 14/460,841, filed Aug. 15, 2014, patent prosecution history.
U.S. Appl. No. 13/025,373 Final Office Action dated Feb. 27, 2014.
U.S. Appl. No. 13/025,373 Final Office Action dated May 20, 2015.
U.S. Appl. No. 13/025,373 Non-Final Office Action dated Aug. 1, 2014.
U.S. Appl. No. 13/025,373 Non-Final Office Action dated May 23, 2013.
U.S. Appl. No. 13/025,373 Non-Final Office Action dated Oct. 6, 2015.
U.S. Appl. No. 13/404,662 Final Office Action dated Dec. 31, 2015.
U.S. Appl. No. 13/404,662 Final Office Action dated Jul. 26, 2017.
U.S. Appl. No. 13/404,662 Non-Final Office Action dated Apr. 3, 2015.
U.S. Appl. No. 13/404,662 Non-Final Office Action dated Mar. 20, 2018.
U.S. Appl. No. 13/404,662 Non-Final Office Action dated Oct. 19, 2016.
U.S. Appl. No. 13/467,588 Final Office Action dated Dec. 27, 2012.
U.S. Appl. No. 13/467,588 Non-Final Office Action dated Oct. 3, 2012.
U.S. Appl. No. 13/467,588 Notice of Allowance dated Apr. 23, 2013.
U.S. Appl. No. 13/594,694 Final Office Action dated Dec. 28, 2015.
U.S. Appl. No. 13/594,694 Final Office Action dated Jul. 13, 2017.
U.S. Appl. No. 13/594,694 Non-Final Office Action dated Apr. 15, 2015.
U.S. Appl. No. 13/594,694 Non-Final Office Action dated Oct. 24, 2016.
U.S. Appl. No. 13/594,694 Office Action dated Apr. 15, 2015.
U.S. Appl. No. 13/594,694 Office Action dated Jun. 12, 2018.
U.S. Appl. No. 13/594,694 Office Action dated Oct. 24, 2016.
U.S. Appl. No. 14/154,906 Office Action dated Apr. 7, 2015.
U.S. Appl. No. 14/154,906 Office Action dated Dec. 11, 2015.
U.S. Appl. No. 14/154,906 Office Action dated May 24, 2017.
U.S. Appl. No. 14/154,906 Office Action dated Oct. 27, 2016.
U.S. Appl. No. 14/460,841 Final Office Action dated Jul. 14, 2016.
U.S. Appl. No. 14/460,841 Final Office Action dated Oct. 10, 2017.
U.S. Appl. No. 14/460,841 Non-Final Office Action dated Feb. 14, 2017.
U.S. Appl. No. 14/460,841 Non-Final Office Action dated Jan. 22, 2016.
U.S. Appl. No. 14/460,841 Restriction Requirement dated Jul. 16, 2015.
U.S. Appl. No. 15/085,398 Final Office Action dated Jan. 12, 2017.
U.S. Appl. No. 15/085,398 Non-Final Office Action dated Jun. 30, 2016.
U.S. Appl. No. 15/085,398 Non-Final Office Action dated Oct. 4, 2017.
Valentine et al., Canine X-linked muscular dystrophy as an animal model of Duchenne muscular dystrophy: a review. American Journal of Medical Genetics, 42 (1992): 352-356.
Valentine et al., Canine X-linked muscular dystrophy: selective involvement of muscles in neonatal dogs. geuromuscul Disord, 1.1 (1991): 31-38.
Valentine, et al. Canine X-linked muscular dystrophy. An animal model of Duchenne muscular dystrophy: clinical studies. J Neurol Sci. Dec. 1988;88(1-3):69-81.
Van Der Putten, et al. Efficient insertion of genes into the mouse germ line via retroviral vectors. Proc. Natl. Acad. Sci. USA, 82 (1985): 6148-1652.
Vasileva et al., Homologous Recombination Is Required for AAV-Mediated Gene Targeting. Nucleic Acids Research, 34.11 (2006): 3345-3360.

(56) References Cited

OTHER PUBLICATIONS

Vătăşescu-Balcan et al. Evidence of Single Point Mutation Inducing BLAD Disease in Romanian Holstein-Derived Cattle Breed. Biotechnology in Animal Husbandry 23(5-6):375-381 (2007).

Veniant et al., Lipoprotein size and atherosclerosis susceptibility in Apoe(-/-) and Ldlr(-/-) mice. Arterioscler Thromb Vasc Biol; 21.10 (2001): 1567-1570.

Visscher et al., Breeding Objectives for Pasture Based Dairy Production Systems. Livestock Production Science, 40 (1994): 123-137.

Vom Dahl et al., Rotational atherectomy does not reduce recurrent in-stent restenosis: results of the angioplasty versus rotational atherectomy for treatment of diffuse in-stent restenosis trial (ARTIST). Circulation J Am Heart Assoc; 105.5 (2002): 583-588.

Wakayama, et al. Full-term development of mice from enucleated oocytes injected with cumulus cell nuclei. Nature, 394 (1998): 369-374.

Wang et al. Generation of knockout rabbits using transcription activator-like effector nucleases. Cell Regeneration, 3:3 (2014). 9 pages.

Warner et al., Expression of Dp260 in muscle tethers the actin cytoskeleton to the dystrophin-glycoprotein complex and partially prevents dystrophy. Hum Mol Genet, 11.9 (2002): 1095-1105.

Watanabe et al, Knockout of Exogenous EGFP Gene in Porcine Somatic Cells Using Zinc-Finger Nucleases. Biochemical and Biophysical Research Communications, 402 (2010): 14-18.

Weiss. Hot prospect for new gene amplifier. Science, 254 (1991): 1292-1293.

Wells et al., Cloning Livestock: A Return to Embryonic Cells. TRENDS in Biotechnology, 21.10 (Oct. 2003): 428-432.

Wheeler et al., Transgenic technology and applications in swine. Theriogenology, 56 (2001): 1345-1369.

Whyte et al, Cell Biology Symposium: Zinc Finger Nucleases to Create Custom-Designed Modifications in the Swine (*Sus scrofa*) Genome. National Swine Resource and Research Center and Division of Animal Science, Jan. 20, 2015.

Whyte et al, Gene Targeting With Zinc Finger Nucleases to Produce Cloned eGFP Knockout Pigs. Mol Reprod Dev 78(1):2-2 (Jan. 2011). First published Dec. 22, 2010. 1 Page. Abstract Only.

Whyte et al, Gene Targeting With Zinc Finger Nucleases to Produce Cloned eGFP Knockout Pigs. Mol. Reprod. Dev. 78.2 (2011): 1 Page. Abstract Only.

Willmann et al., Mammalian animal models for duchenne muscular dystrophy, Neuromuscular disorders. 19 (2009): 241-249.

Wilmut, et al. Viable offspring derived from fetal and adult mammalian cells. Nature, 385 (1997): 810-813.

Winnard et al, Frameshift deletions of exons 3-7 and revertant fibers in Duchenne muscular dystrophy: mechanisms of dystrophin production. Am J Hum Genet, 56 (1995): 158-166.

Xu et al., CMV-β-Actin Promoter Directs Higher Expression from an Adeno-Associated Viral Vector in the Liver than the Cytomegalovirus or Elongation Factor 1α Promoter and Results in Therapeutic Levels of Human Factor X in Mice, Hum Gene Ther., 12 (2001): 563-573.

Xu et al., Direct removal in the mouse of a floxed neo gene from a three-loxP conditional knockout allele by two novel approaches. Genesis, 30.1 (2001): 1-6.

Xu et al., Direct Removal in the Mouse of a Floxed Neo Gene From a Three-loxP Conditional Knockout Allele by Two Novel Approaches. Technology Report, 30 (2001): 1-6.

Yamamoto Targeted Genome Editing Using Site-Specific Nucleases, 2015, p. 144 only.

Yamanishi, Kiyofumi, Gene-knockout mice with abnormal epidermal and hair follicular development. Journal of Dermatological Science 18 (1998): 75-89.

Yan et al, Progress and Prospect: Techniques for Site-Directed Mutagenesis in Animal Models. Gene Therapy, 16 (2009): 581-588.

Yanez et al., Gene Targeting is Enhanced in Human Cells Overexpressing hRAD51. (Feb. 26, 1999): Gene Therapy.

Yang et al, Cattle Call for Gene Targeting. Nature, 36.7 (Jul. 2004): 671-672.

Yang et al. Generation of PPARγ mono-allelic knockout pigs via zinc-finger nucleases and nuclear transfer cloning. Cell Research 21:979-982 (2011). doi: 10.1038/cr.2011.70. Published online Apr. 19, 2011.

Yoshida et al., Glycoprotein complex anchoring dystrophin to sarcolemma. Journal of Biochemistry, 108 (1990): 748-752.

Yu et al., Highly Efficient Modification of Beta-Lactogiobulin (BLG) Gene Via Zinc-Finger Nucleases in Cattle. Cell Research 21 (2011): 1638-1640.

Zhang et al. Efficient construction of sequence-specific TAL effectors for modulating mammalian transcription. Nature Biotechnology vol. 29, pp. 149-153 (Jan. 19, 2011).

Blomberg et al. Twenty Years of Embryonic Stem Cell Research in Farm Animals. Reprod Dom Anim 47(Suppl. 4):80-85 (2012). First published Jul. 25, 2012. DOI: https://doi.org/10.1111/j.1439-0531.2012.02059.x.

EP18199895.6 Office Action dated Apr. 2, 2020.

Koh et al. From "ES-like" cells to induced pluripotent stem cells: A historical perspective in domestic animals. Theriogenology 81(1):103-111 (Jan. 1, 2014). DOI: https://doi.org/10.1016/j.theriogenology.2013.09.009.

Soto et al. Pluripotent stem cells and livestock genetic engineering. Transgenic Res 25(3):289-306 (Jun. 2016). Published online Feb. 19, 2016. doi: 10.1007/s11248-016-9929-5.

\* cited by examiner

Bovine Embryos

Insertions:

Wt. CCCTCTTCCTTTCCTTCCTCCAGGGATCCCTCCTACATGGCCTCCCACTGGAGAAGCAACAGAGGAGCACACAGA (SEQ ID NO:1)

1. CCCTCTTCCTTTCCTTCCTCCAGGGATCCCTCCTACAgGGA 4 bp CTCCCACTGGAGAAGCAACAGAGAGGAGCACACAGA (SEQ ID NO:2)
2. CCCTCTTCCTTTCCTTCCTCCAGGGATCCCTCCTAC 12bp CTCCCACTGGAGAAGCAACAGAGAGGAGCACACAGA (SEQ ID NO:3)

Deletions:

Wt. CCCTCTTCCTTTCCTTCCTCCAGGGATCCCTCCTACATGGCCTCCCACTGGAGAAGCAACAGAGGAGCACACAGA (SEQ ID NO:4)

1. CCTTCTTCCTTTCCTTCCTCCAGGGATCCCTCCTCC------------CACTGGAGAAGCAACAGAACAGAGGAGCACACAGA Δ12bp (x3) (SEQ ID NO:5)
2. CCCTCTTCCTTTCCTTCCTCCAGGGATCCCTCCTACtT------CCCACTGGAGAAGCAACAGAGGAGCACACAGA Δ5bp (SEQ ID NO:6)

FIG. 4

```
WT ACAN12
TCGCCTTCCCTCTTCCTTCCTCCCAGGGATCCCTCCTACATGGCCTCCCACTGGAGAAGCAACAGAGAGGAGCACACAGAAGGCCCTTCT
GCAACGGAA  (SEQ ID NO: 26)
TCGCCCTTCCCTCTTCCTTCCTCCCAGGGATCCCTCCTACATGGCttggCCTCCCACTGGAGAAGCAACAGAGGAGCACACAGAAGGCC
CTTCTGCAA  (SEQ ID NO: 27)
TCGCCCTTCCCTCTTCCTTCCTCCCAGGGATCCCTCCTACATGGC-
TCCCACTGGAGAAGCAACAGAGGAGCACACAGAAGGCCCTTCTGCAACGGAA  (SEQ ID NO: 28)
TCGCCCTTCCCTCTTCCTTCCTCCCAGGGATCCCTCCTACATGGCtggC-
CTCCCACTGGAGAAGCAACAGAGGAGCACACAGAAGGCCCTTCTGCAA  (SEQ ID NO: 29)
TCGCCCTTCCCTCTTCCTTCCTCCCAGGGATCCCTCCTAC-------
GCCTCCCACTGGAGAAGCAACAGAGGAGCACACAGAAGGCCCTTCTGCAACGGAA  (SEQ ID NO: 30)
TCGCCCTTCCCTCTTCCTTCCTCCCAGGGATCCCTCCTACtT-------
CCCACTGGAGAAGCAACAGAGGAGCACACAGAAGGCCCTTCTGCAACGGAA  (SEQ ID NO: 31)
TCGCCCTTCCCTCTTCCTTCCTCCCAGGGATCCCTCCTAC---------
TCCCACTGGAGAAGCAACAGAGGAGCACACAGAAGGCCCTTCTGCAACGGAA  (SEQ ID NO: 32)
TCGCCCTTCCCTCTTCCTTCCTCCCAGGGATCCCTCCT-----------
gCTCCCACTGGAGAAGCAACAGAGGAGCACACAGAAGGCCCTTTCTGCAACGGAA  (SEQ ID NO: 33)
TCACCCTTCCCTCTTCCTTCCTCCCAGGGATCCCTCC--------------
CACTGGAGAAGCAACAGAGGAGCACACAGAAGGCCCTTCTGCAACGGAA  (SEQ ID NO: 34)
TCGCCCTTCCCTCTTCCTTCCTCCCAGGGATC----------------
CCTCCCACTGGAGAAGCAACAGAGGAGCACACAGAAGGCCCTTTCTGCAACGGAA  (SEQ ID NO: 35)
TCGCCCTTCCCTCTTCCTTCCTCCCAGGGATCCCTCCTACAT------
ACAGAGGAGCACACAGAAGGCCCTTCTGCAACGGAA  (SEQ ID NO: 36)
TCGCCCTTCCCTCTTCCTTCCTCCCAGGGATCCCTCCTACAT[TTT]GGCCTCCCACTGGAGAAGCAACAGAGGAGCACACAGAAGGCCCTTC
TGCAACGGAA  (SEQ ID NO: 37)
TCGCCCTTCCCTCTTCCTTCCTCCCAGGGATCCCTCCTACAggGA[TCTT]TCCCACTGGAGAAGCAACAGAGGAGCACACAGAAGGCCCC
TTCTGCAACGGAA  (SEQ ID NO: 38)
```

FIG. 6

LDLR Bi-allelic KO clone genotypes

LDLR E2 Bi-allelic Clones with two indels

```
11. GGGAAATGCATCTCCTACAAGTGGA--------------------CGGGTCCGATGAGTCCCTGGAGACG  Δ28  x2   ⊘  SEQ ID 79
    TGCTGATCCTGGCACTGAT--------delta 116--------caaGGACGGGTCCGATGAGTCCCTGGAGACG  Δ116 x6      SEQ ID 80

12. GGGAAATGCATCTCCTACAAGTGGA--------------------CGGGTCCGATGAGTCCCTGGAGACG  Δ28  x2   ⊘  SEQ ID 81
    TGCTGATCCTGGCACTGAT--------delta 116--------caaGGACGGGTCCGATGAGTCCCTGGAGACG  Δ116 x4      SEQ ID 82
    TAGACACAGGGAGTATGGTCACTTG--------delta 136--------3'CTGATTCCCACCGAGT 5'RA x1               SEQ ID 83

13. GGGAAATGCATCTCCTACAAGTGGATTTG--------CACCGAGTGCAAGGACGGGTCCGATGAGTCCCTGGAGACG  Δ9  x5    SEQ ID 84
    GGGAAATGCATCTCCTACAAGTGGATT---TGTGATG--GGAA---CACCGAGTGCAAGGACGGGTCCGATGAGTCCC           SEQ ID 85
    GGGAAATGCATCTCCTACAAGTGCAagGAGTGCAaggACCGAGTGCAAGGACGGGTCCGATGAGTCCC  Ins7 x4            SEQ ID 86

14. GGGAAATGCATCTCCTACAAGT--------Δ133--------TGCATTCCGCTGTGAATTAGGATGTGGGCGGAGA  Δ133 x7    SEQ ID 87
    GGGAAATGCATCTCCTACAAGTGGATTTGTGATG----ACACCGAGTGCAAGGACGGGTCCGATGAGTCCCTGGAGACG  Δ3 x2   SEQ ID 88
Wt: 1

15. GGCTCATTTCTCAGCTtGCA--------Δ161--------GTGCAAGGACGGGTCCGGTGAGTCCCTGGAGACG  Δ161 x4  ⊘  SEQ ID 89
    GGGAAATGCATCTCCTACAAGTGGATTTGTGATac--ACACCGAGTGCAAGGACGGGTCCGATGAGTCCCTGGAGACG  Δ2 x5      SEQ ID 90
Wt: 1
```

⊘ 7/15 result in bi-allelic frameshift

FIG. 8B

DMD Bi-allelic KO clone genotypes

DMDE7 Bi-allelic clones with homozygous indel

```
Wt. GCCACACAACGACTGGAACATGCATTCAACATCGCCAAGTATCAGTTAGGCATAGAGAAACTACTGGATCCTGAAGGTT                          SEQ ID 55
1.  GCCACACAACGACTGGAACATGCATTCAACATCGCCA----TCAGTTAGGCATAGAGAAACTACTGGATCCTGAAGGTT        Δ4              SEQ ID 56
2.  GCCACACAACGACTGGAACATGCATTCAACATCGCCA-------GTTAGGCATAGAGAAACTACTGGATCCTGAAGGTT        Δ7      🚫      SEQ ID 57
3.  GCCACACAACGACTGGAACATGCATTCAACATC----------AGTTAGGCATAGAGAAACTACTGGATCCTGAAGGTT        Δ10     🚫      SEQ ID 58
4.  GCCACACAACGACTGGAACATGCATTCAACATCGCCA 357bp CAGTTAGGCATAGAGAAACTACTGGATCCTGAAGGTT       ins357          SEQ ID 59
5.  GCCACACAACGACTGGAACATGCATTCAACATCGCCAAGT|ATCAGTTAGGCATAGAGAAACTACTGGATCCTGAAGGTT       ins326  🚫      SEQ ID 60
```

DMD Bi-allelic Two indels

```
Wt. GCCACACAACGACTGGAACATGCATTCAACATCGCCAAGTATCAGTTAGGCATAGAGAAACTACTGGATCCTGAAGGTT                           SEQ ID 61
6.  
    CCCACACAACGACTGGAACATGCATTCAACATGCATaaTaTA|TCAGTTAGGCATAGAGAAACTACTGGATCCTGAAGGTT     Ins3  x5            SEQ ID 62
    GCCACACAACGACTGGAACATGCATTCAACATCGCCAA--ATCAGTTAGGCATAGAGAAACTACTGGATCCTGAAGGTT       Δ2    x5            SEQ ID 63
7.  
    GCCACACAACGACTGGAACATGCATTCAACATC----------AGTTAGGCATAGAGAAACTACTGGATCCTGAAGGTT       Δ10   x7            SEQ ID 64
    GCCACACAACGACTGGAACATGCATTCAACATGCCAAGTA|TCAGTTAGGCATAGAGAAACTACTGGATCCTGAAGGTT       Ins3  x1            SEQ ID 65
8.  
    GCCACACAACGACTGGAACATGCATTCAACATCGCCAA---TCAGTTAGGCATAGAGAAACTACTGGATCCTGAAGGTT       Δ3    x8            SEQ ID 66
    GCCACACAACGACTGGAACATGCATTCAACATCGCCAAGTAT----TAGGCATAGAGAAACTACTGGATCCTGAAGGTT       Δ4    x3            SEQ ID 67
```

🚫 4/8 Result in bi-allelic frameshift

FIG. 9A

LDLR Bi-allelic KO clone genotypes

LDLR E2 Bi-allelic Clones with homozygous indel

```
Wt.  GGGAAATGCATCTCCTACAAGTGGATTTGTGATGGAAACACCGAGTGCAAGGACGGGTCCGATGAGTCCCTGGAGACG                SEQ ID 68
 1.  GGGAAATGCATCTCCTACAAGTGGATTTGTGATGGGGAACACCGAGTGCAAGGACGGGTCATAAGAGTCCCTGGAGACGGTG  2ins ⊘    SEQ ID 69
 2.  GGGAAATGCATCTCCTACAAGTGGATTTGTG-----GAACACCGAGTGCAAGGACGGGTCCGATGAGTCCCTGGAGACG     Δ4        SEQ ID 70
 3.  GGGAAATGCATCTCCTACAAGTGGATTTGTG-----GAACACCGAGTGCAAGGACGGGTCCGATGAGTCCCTGGAGACG     Δ4    ⊘⊘⊘ SEQ ID 71
 4.  GGGAAATGCATCTCCTACAAGTGGATTTGTG-----GAACACCGAGTGCAAGGACGGGTCCGATGAGTCCCTGGAGACG     Δ4        SEQ ID 72
 5.  GGGAAATGCATCTCCTACAAGTGGATTTG---------CACCGAGTGCAAGGACGGGTCCGATGAGTCCCTGGAGACG      Δ9        SEQ ID 73
 6.  GGGAAATGCATCTCCTACAAGTGGACTTG---------CACCGAGTGCAAGGACGGGTCCGATGAGTCCCTGGAGACG      Δ9        SEQ ID 74
 7.  GGGAAATGCATCTCCTACAAGTGGATTTGTGA------------GTGCAAGGACGGGTCCGATGAGTCCCTGGAGACG      Δ12       SEQ ID 75
 8.  GGGAAATGCATCTCCTACAAGTGGATTTGTGA------------GTGCAAGGACGGGTCCGATGAGTCCCTGGAGACG      Δ12       SEQ ID 76
 9.  GGGAAATGCATCTCCTACAAGTG------------------------CAAGGACGGGTCCGATGAGTCCCTGGAGACG      Δ24       SEQ ID 77
10.  GGGAAATGCATCTCCTACAAG------------------------------GACGGGTCCGATGAGTCCCTGGAGAaG      Δ30       SEQ ID 78
```

FIG. 9B

DMD Deletion Junctions

| | | SEQ ID |
|---|---|---|
| DMDE6, left TALEN underlined | DMDE7; right TALEN underlined | |
| TCTTATACCTAGGTCAAAAATGTAATGAAGAA | AGTATCAGTTAGGCATAGAGAAACTACTGGA | SEQ ID 91 |
| Replicate 1 029_30 | | |
| TCTTATACCTAGGTCAAAAATGTAAT------ | ----------TCAGTTAGGCATAGAGAAACTACTGGA | SEQ ID 92 |
| TCTTATACCTAGGTCAAAAATGTAATGA---- | ----------TCAGTTAGGCATAGAGAAACTACTGGA | SEQ ID 93 |
| TCTTATACCTAGGTCAAAAATGTAATGA GACAG | -GTATCAGTTAGGCATAGAGAAACTACTGGA | SEQ ID 94 |
| TCTTATACCTAGGTCAAAAAATGT-------- | ---TAGGCATAGAGAAACTACTGGA | SEQ ID 95 |
| TCTTATACCTAGGTCAAAAATGTA-------- | ----GGCATAGAGAAACTACTGGA | SEQ ID 96 |
| TCTTATACCTAGGTCAAAAATGTAAT------ | ---CAGTTAGGCATAGAGAAACTACTGGA | SEQ ID 97 |
| Replicate 2 028_30 | | |
| TCTTATACCTAGGTCAAAAATGTAATGAA--- | -----GTATCAGTTAGGCATAGAGAAACTACTGGA | SEQ ID 98 |
| TCTTATACCTAGGTCAAAAATGCAATGTAATGAAGAA A | -TATCAGTTAGGCATAGAGAAACTACTGGA | SEQ ID 99 |
| TCTTATACCTAGGTCAAAAATGTAATGAAGAA TTAAA | -TATCAGTTAGGCATAGAGAAACTACTGGA | SEQ ID 100 |
| TCAATACCTAGGTCAAAAATGTAATGAAGA-- | -----GTATCAGTTAGGCATAGAGAAACTACTGGA | SEQ ID 101 |
| TCTTATACCTAGGTCAAAAATGTAAAG----- | -----GTATCAGTTAGGCATAGAGAAACTACTGGA | SEQ ID 102 |
| TCTTATACCTAGGTCAAAAATGTAATGA AAAAGGG | GTATCAGTTAGGCATAGAGAAACTACTGGA | SEQ ID 103 |
| TCTTATACCTAGGTCAAAAATT---------- | -----ATCAGTTAGGCATAGAGAAACTACTGGA | SEQ ID 104 |
| TCTTATACCTAGGTCAAAATGTAA-------- | -GAATCAGTTAGGCATAGAGAAACTACTGGA | SEQ ID 105 |

FIG. 11

Inversion Junctions

5' Junctions

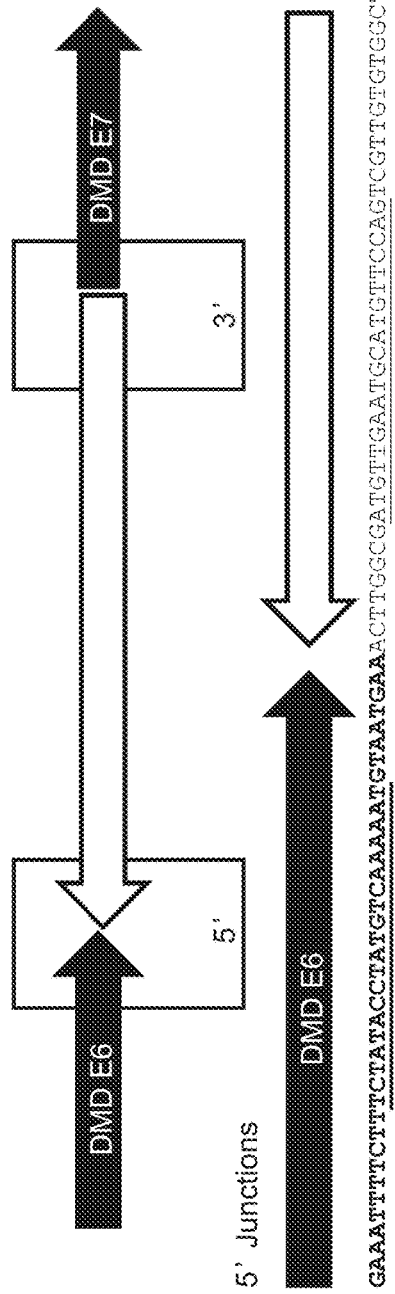

| Sequence | SEQ ID |
|---|---|
| GAAATTTTCTTTTCTATACCTATGTCAAAAATGTAATGAAACTTGGCGATGTTGAATGCATGTTCCAGTCGTTGTGTGGCTG | SEQ ID 106 |
| GAAATTTTCTTTTCTATACCTATGTCAAAAATGTAATGA------TGGCGATGTTGAATGCATGTTCCAGTCGTTGTGTGGCTG x3 | SEQ ID 107 |
| GAAATTTTCTTTTCTATACCTA--------------------gGGCGATGTTGAATGCATGTTCCAGTCGTTGTGTGGCTG x5 | SEQ ID 108 |
| GAAATTTTCTTTTCTATACCTAGGTCAAAAATGTA-------TGGCGATGTTGAATGCATGTTCCAGTCGTTGTGTGGCTG x2 | SEQ ID 109 |
| GAAATTTTCTTTTCTATACCTAGGTCAAAAATGTAATGAAGACTTGGCGATGTTGAATGTTCCAGTCGCGTGTGGCTG ins 1 | SEQ ID 110 |
| GAAATTTTCTTTTCTATACCTAGGTCAAAAATGTAATGAAGATCTTGGCCGATGTCATGTTCCAGTCGTTGTGTGGCTG ins 5 | SEQ ID 111 |
| GAAATTTTCTTTTCTATACCTAGGTCAAAAATGTAATGAAGATGATACTTGGCCGATGTCATGTTCCAGTTCCAGTCGTTGTGTGGCTG ins 6 | SEQ ID 112 |

3' Junctions

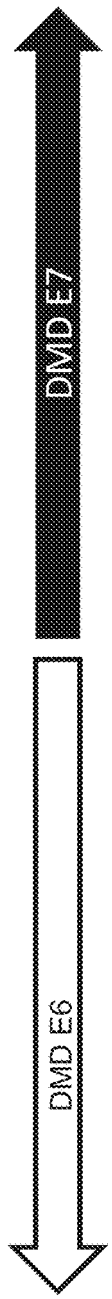

| Sequence | SEQ ID |
|---|---|
| TTTTCACTGTTAGTTGTTGCAATCCAGCCATGATATTCATCAGTTAGGCATAGAGAAACTACTGGATCCTGAAGGTTA | SEQ ID 113 |
| TTTTCACTGTTAGTTGTTGCAATCCAGCCATGATATTCTTAGTATACAGTTAGGCATAGAGAAACTACTGGATCCTGAAGGTTA ins 5 | SEQ ID 114 |
| TTTTCACTGTTggTTTGTTGCAATCCAGCCAaGATATAtATCAGTTAGGCATAGAGCAACTACTGGATCCTGAAGGTTA | SEQ ID 115 |

FIG. 12

Carlson +63 TALEN

Sequence alignment — N-Terminal Leader Portion, 5' Portion, +63, Half RVD, Fok1

Section 1 (positions 1–44):
- Carlson +63 last RVD (1): ----------------------MASSPPKKKRKVSWKDASGWSRVD
- Sangamo +63 Half RVD (1): MDYKDHDGDYKDHDIDYKDDDDKMAPKKKR--KVGIHRGVPMVD Section 2 (45–88):
- Carlson +63 last RVD (25): LRTLGYSQQQEKIKPKVRSTVAQHHEALVGHGFTHAHIVALSQ
- Sangamo +63 Half RVD (43): LRTLGYSQQQEKIKPKVRSTVAQHHEALVGHGFTHAHIVALSQ Section 3 (89–132):
- Carlson +63 last RVD (69): HPAALGTVAVTYQHIITALPEATHEDIVGVGKQWSGARALEALL
- Sangamo +63 Half RVD (87): HPAALGTVAVKYQDMIAALPEATHEAIVGVGKQWSGARALEALL Section 4 (133–176):
- Carlson +63 last RVD (113): TDAGELRGPPLQLDTGQLYKIAKRGGVTAMEAVHASRNALTGAP
- Sangamo +63 Half RVD (131): TVAGELRGPPLQLDTGQLKIAKRGGVTANEAVHAWRNALTGAP Section 5 (177–220):
- Carlson +63 last RVD (157): LNLTPDQVVAIASNGGGKQALESIVAQLSRPDPALAALTNDHLV
- Sangamo +63 Half RVD (175): LNLTPEQVVAIASNGGGRPALESIVAQLSRPDPALAALTNDHLV Section 6 (221–264):
- Carlson +63 last RVD (201): ALACLGGRPAMDAVKKGLPHAPELIRRVNRRIGERTSHRVASRS
- Sangamo +63 Half RVD (219): ALACLGGRPADAVKKGLPHAPALIRVNRRIPERTSHRVAG-S Section 7 (265–308):
- Carlson +63 last RVD (245): QLVKSFLEEKKSELRHKLKYVPHEYIELIEIARNSTQDRILEMK
- Sangamo +63 Half RVD (262): QLVKSFLEEKKSELRHKLKYVPHEYIELIEIARNSTQDRILEMK Section 8 (309–352):
- Carlson +63 last RVD (289): VMEFFMKVYGYRGKHLGGSRKPDGAIYTVGSPIDYGVIVDTKAY
- Sangamo +63 Half RVD (306): VMEFFMKVYGYRGKHLGGSRKPDGAIYTVGSPIDYGVIVDTKAY Section 9 (353–396):
- Carlson +63 last RVD (333): SGGYNLPIGQADEMQRYVEENQTRNKHINPNEWWKVYPSSVTEF
- Sangamo +63 Half RVD (350): SGGYNLPIGQADEMQRYVEENQTRNKHINPNEWWKVYPSSVTEF Section 10 (397–440):
- Carlson +63 last RVD (377): KFLFVSGHFKGNYKAQLTRLNHITNCNGAVLSVEELLIGGEMIK
- Sangamo +63 Half RVD (394): KFLFVSGHFKGNYKAQLTRLNHITNCNGAVLSVEELLIGGEMIK Section 11 (441–462):
- Carlson +63 last RVD (421): AGTLTLEEVRRKFNNGEINF--  SEQ ID NO: 129
- Sangamo +63 Half RVD (438): AGTLTLEEVRRKFNNGEINFRS  SEQ ID NO: 130

FIG. 16

>pT3TS-LF-deltaTAL
T3 primer binding site —— 1
5' UTR —— 2
TALEN 5'- Carlson —— 3
LacZ- stuffer fragment from Cermak et. al. 2011 for blue white screening of clones. —— 4
Fok I homodimer —— 5
3' TALEN +18-+63  3' TALEN +1-17 provided by last TALEN repeat in final cloning step. —— 6
3' UTR - polyA —— 7
Poly-C– potentially protects mRNA from degradation. —— 8 catgttctttcctgcgttatcccctgattctgtggataaccgtattaccgcctttgagtgagctgataccgctcgccgcagccgaacgaccgagcgcagc
gagtcagtgagcgaggaagcggaagagcgcccaatacgcaaaccgaattaaccctcactaaagggaagcttgcttgttcttttgcagaagctcaga  1,2
ataaacgctcaactttggcagatctaactcgagaaagatattgtatatatcgtaacaataggaggttcaacaatggcttcctcccctccaaagaaaaa
gagaaaggttagttggaaggacgcaagtggttggtctagagtggatctacgcacgctcggctacagtcagcagcagcaagagaagatcaaaccgaa
ggtgcgttcgacagtggcgcagcaccacgaggcactggtgggccatgggtttacacacgcgcacatcgttgcgctcagccaacacccggcagcgtta  3
gggaccgtcgctgtcacgtatcagcacataatcacggcgttgccagaggcgacacacgaagacatcgttggcgtcggcaaacagtggtccggcgcac
gcgccctggaggccttgctcacggatgcgggggagttgagaggtccgccgttacagttggacacaggccaacttgtgaagattgcaaaacgtggcgg
cgtgaccgcaatggaggcagtgcatgcatcgcgcaatgcactgacgggtgcccctggagacgggcgccgctacagggcgcgtcccattcgccatt  4
caggctgcgcaactgttgggaagggcgatcggtgcgggcctcttcgctattacgccagctggcgaaaggggatgtgctgcaaggcgattaagttgg
gtaacgccagggttttcccagtcacgacgttgtaaaacgacggccagtgagcgcgcgtaatacgactcactatagggcgaattgggtaccgggccccc
cctcgaggtcctccagcttttgttccctttagtgagggttaattgcgcgcttggcgtaatcatggtcatagctgtttcctgtgtgaaattgttatccgctcac
aattccacacaacatacgagccggaagcataaagtgtaaagcctggggtgcctaatgagtgagctaactcacattaattgcgttgcgctcactgcccg  5
ctttccaccggtcgtctcgaacgaccacctcgtcgcccttggcctgcctcggcggacgtcctgccatggatgcagtgaaaaaggggattgccgcacgcgcc
ggaattgatcagaagagtcaatcgccgtattggcgaacgcacgtcccatcgcgttgcctctagatcccagctagtgaaatctgaattggaagagaaga
aatctgaacttagacataaattgaaatatgtgccacatgaatatattgaattgattgaaatcgcaagaaattcaactcaggatagaatccttgaaatga
aggtgatggagttctttatgaaggtttatggttatcgtggtaaacatttgggtggatcaaggaaaccagacggagcaatttatactgtcggatctcctat  6
tgattacggtgtgatcgttgatactaaggcatattcaggaggttataatcttccaattggtcaagcagatgaaatgcaaagatatgtcgaagagaatca
aacaagaaacaagcatatcaaccctaatgaatggtggaaagtctatccatcttcagtaacagaatttaagttcttgtttgtgagtggtcatttcaaagg
aaactacaaagctcagcttacaagattgaatcatatcactaattgtaatggagctgttcttagtgtagaagagcttttgattggtggagaaatgattaa  7
agctggtacattgacacttgaggaagtgagaaggaaatttaataacggtgagataaacttttaataggctagtgactgactaggatcggttaccact
aaaccagcctcaagaacacccgaatggagtctctaagctacataataccaacttacacttacaaaatgttgtcccccaaaatgtagccattcgtatctg
ctcctaataaaaagaaagtttcttcacattctaaaaaaaaaaaaaaaaaaaaaaaaaaacccccccccccccccccccccccccccgcat
gcctgcaggtcgactaggatccccgggtaccgagctccaattcgccctatagtgagtcgtattacaattcactggccgtcgttttacaacgtcgtgactg  8
ggaaaaccctggcgttacccaacttaatcgccttgcagcacatccccctttcgccagctggcgtaatagcgaagaggcccgcaccgatcgcccttccca
acagttgcgcagcctgaatggcgaatggaaattgtaagcgttaatattttgttaaaattcgcgttaaattttgttaaatcagctcatttttaaccaata

FIG. 17-1 ggccgaaatcggcaaaatcccttataaatcaaaagaatagaccgagatagggttgagtgttgttccagtttggaacaagagtccactattaaagaac
gtggactccaacgtcaaagggcgaaaaaccgtctatcagggcgatggcccactacgtgaaccatcaccctaatcaagttttttggggtcgaggtgccg
taaagcactaaatcggaaccctaaagggagccccgatttagagcttgacggggaaagccggcgaacgtggcgagaaaggaagggaagaaagcg
aaaggagcgggcgctagggcgctggcaagtgtagcggtcacgctgcgcgtaaccaccacacccgccgcgcttaatgcgccgctacagggcgcgtca
ggtggcacttttcggggaaatgtgcgcggaaccccctatttgtttatttttctaaatacattcaaatatgtatccgctcatgagacaataaccctgataaat
gcttcaataatattgaaaaaggaagagtatgagtattcaacatttccgtgtcgcccttattccctttttgcggcattttgccttcctgttttgctcaccca
gaaacgctggtgaaagtaaaagatgctgaagatcagttgggtgcacgagtgggttacatcgaactggatctcaacagcggtaagatccttgagagttt
tcgccccgaagaacgttttccaatgatgagcacttttaaagttctgctatgtggcgcggtattatcccgtattgacgccgggcaagagcaactcggtcgc
cgcatacactattctcagaatgacttggttgagtactcaccagtcacagaaaagcatcttacggatggcatgacagtaagagaattatgcagtgctgc
cataaccatgagtgataacactgcggccaacttacttctgacaacgatcggaggaccgaaggagctaaccgcttttttgcacaacatgggggatcatg
taactcgccttgatcgttgggaaccggagctgaatgaagccataccaaacgacgagcgtgacaccacgatgcctgtagcaatggcaacaacgttgcg
caaactattaactggcgaactacttactctagcttcccggcaacaattaatagactggatggaggcggataaagttgcaggaccacttctgcgctcggc
ccttccggctggctggttttattgctgataaatctggagccggtgagcgtgggtctcgcggtatcattgcagcactggggccagatggtaagccctcccgt
atcgtagttatctacacgacggggagtcaggcaactatggatgaacgaaatagacagatcgctgagataggtgcctcactgattaagcattggtaact
gtcagaccaagtttactcatatatactttagattgatttaaaacttcatttttaatttaaaaggatctaggtgaagatcctttttgataatctcatgaccaa
aatcccttaacgtgagttttcgttccactgagcgtcagaccccgtagaaaagatcaaaggatcttcttgagatcctttttttctgcgcgtaatctgctgctt
gcaaacaaaaaaaccaccgctaccagcggtggtttgtttgccggatcaagagctaccaactctttttccgaaggtaactggcttcagcagagcgcaga
taccaaatactgtccttctagtgtagccgtagttaggccaccacttcaagaactctgtagcaccgcctacatacctcgctctgctaatcctgttaccagtg
gctgctgccagtggcgataagtcgtgtcttaccgggttggactcaagacgatagttaccggataaggcgcagcggtcgggctgaacggggggttcgtg
cacacagcccagcttggagcgaacgacctacaccgaactgagatacctacagcgtgagctatgagaaagcgccacgcttcccgaagggagaaagg
cggacaggtatccggtaagcggcagggtcggaacaggagagcgcacgagggagcttccaggggaaacgcctggtatctttatagtcctgtcgggtt
tcgccacctctgacttgagcgtcgatttttgtgatgctcgtcaggggggcggagcctatggaaaaacgccagcaacgcggccttttacggttcctggcc
ttttgctggccttttgctca SEQ ID NO: 131

FIG. 17-2

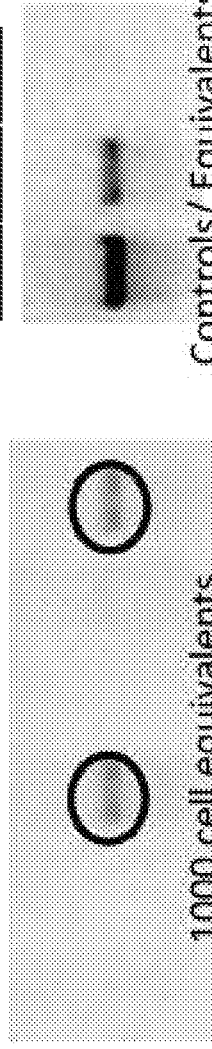
FIG. 19

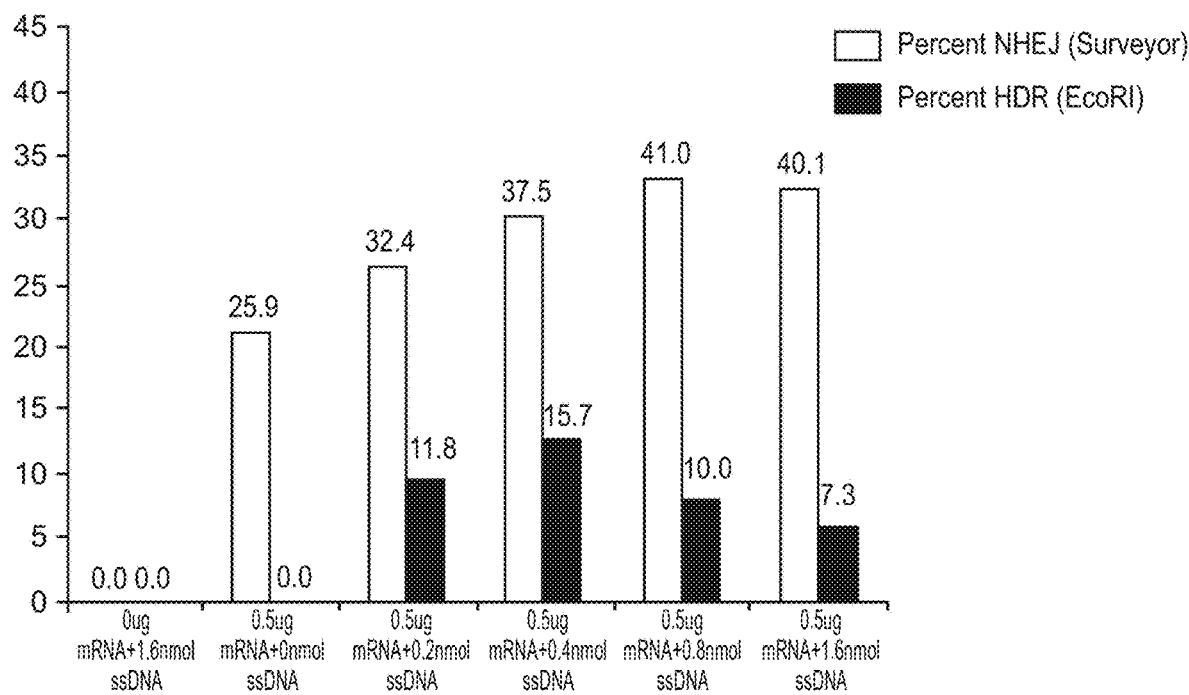
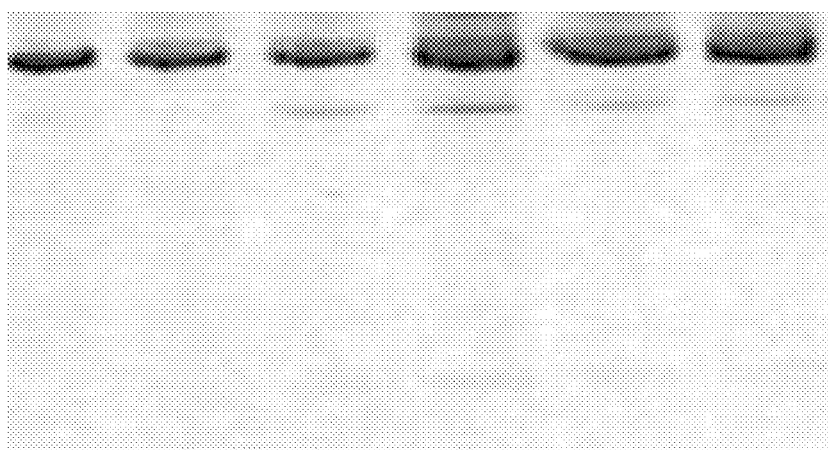
FIG. 24

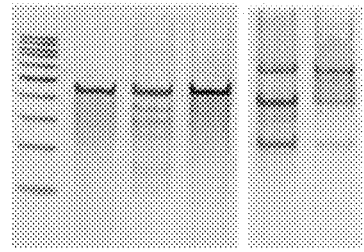
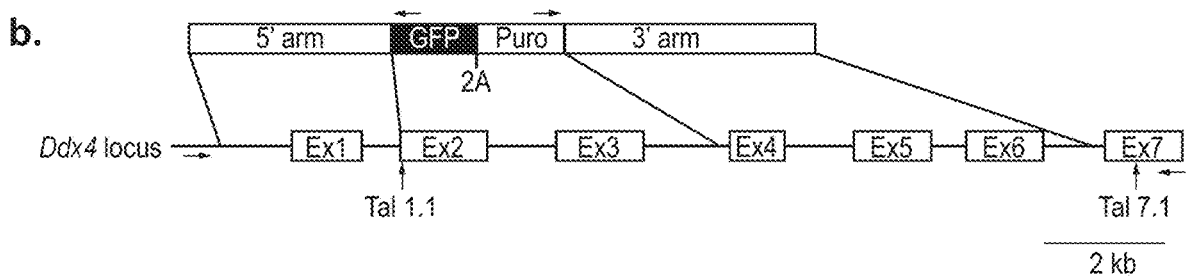
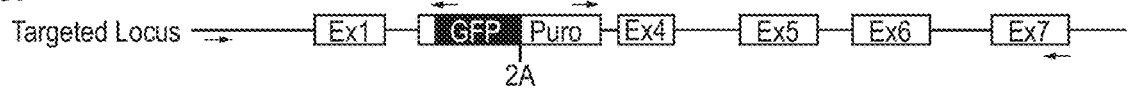
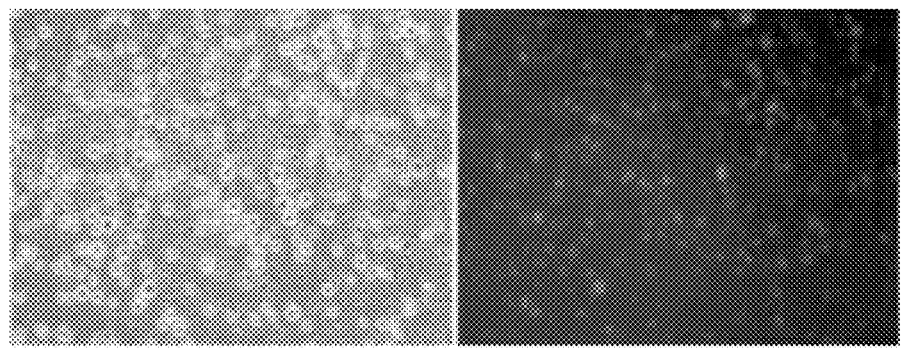
FIG. 27

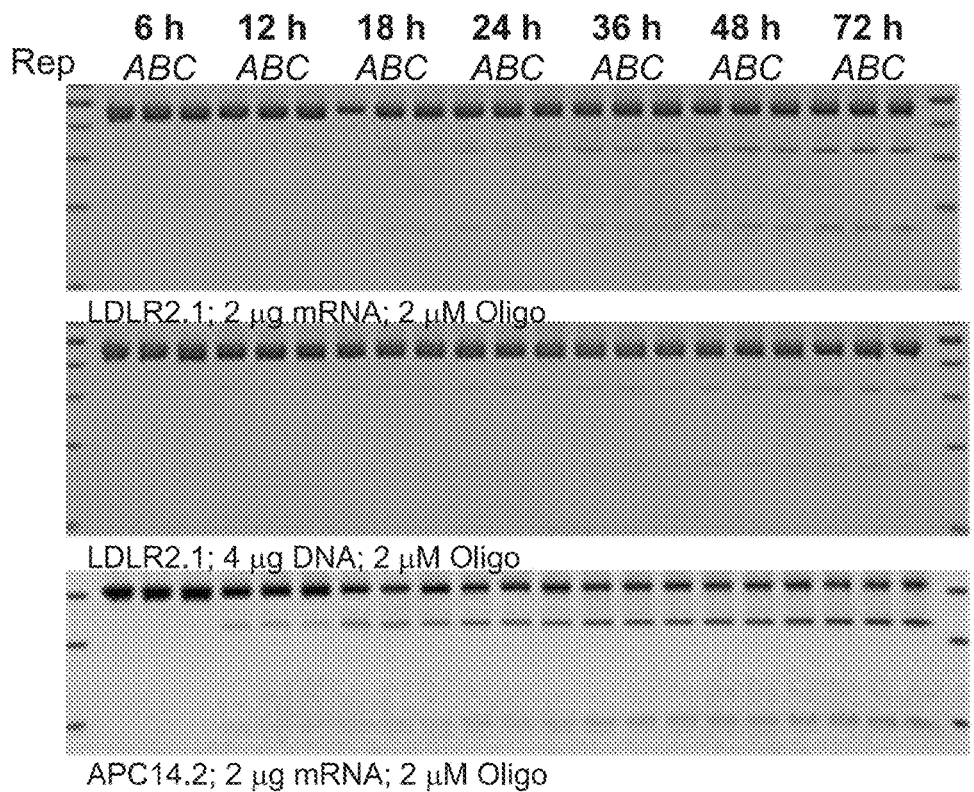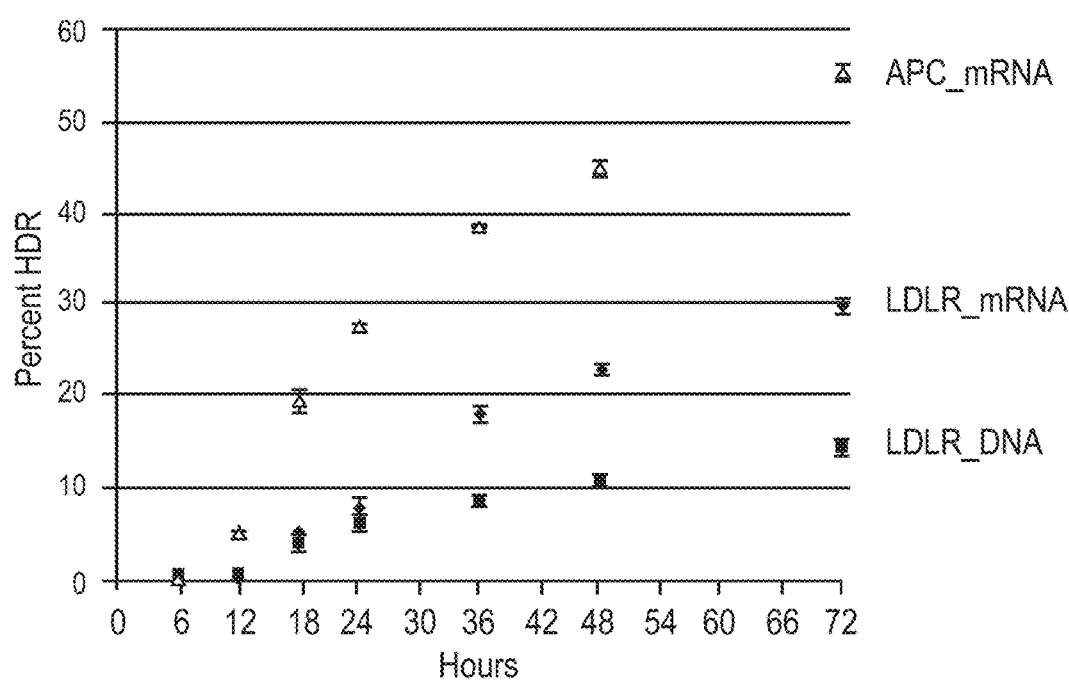
FIG. 37B a

```
            CCGTCCTTTGCCAAcCTT              AGCAACCGTGGGCCCCAA
Wt-NL  TCCGTCCTTTGCCAAcCTTGGCCGACCAGCCCTAGCAACCGTGGGCCCCAA
DF-HDR TCCGTCCTTTGCCGAcTTCGGCCGACCAGCCCTAGCAACCGTGGGCCCCAA
                        EagI
``` b

TALENs  −  +

Eagl Cleavage products

%HDR  0  52 c

FIG. 44

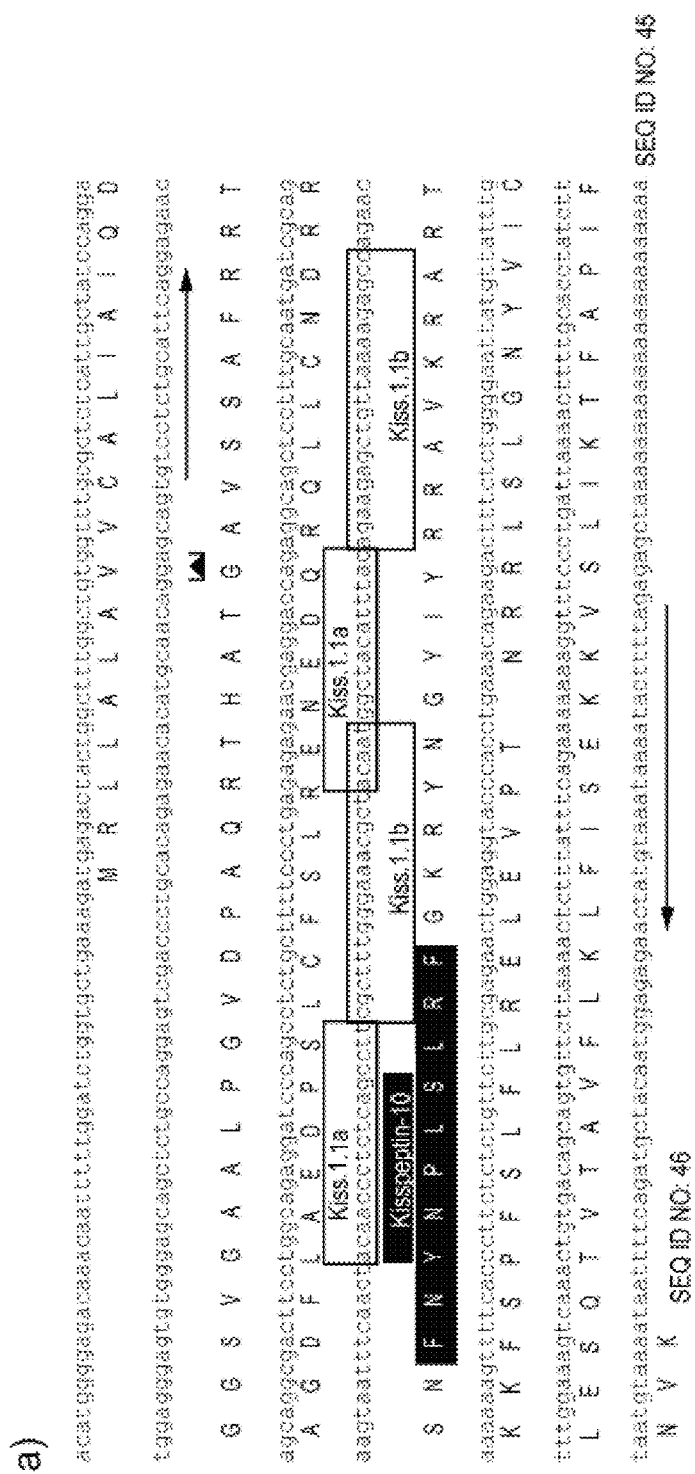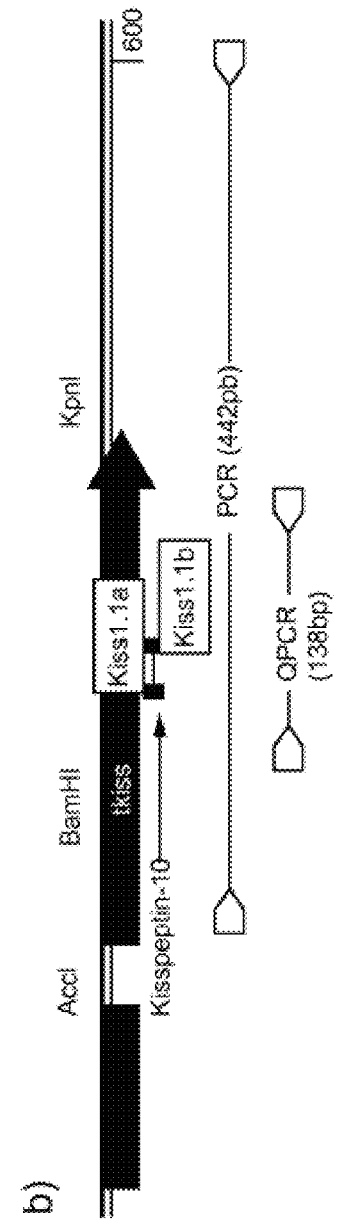
FIG. 56 a)

```
aactcctgtcacgaagtactcctccgaggagctgtggaactccacagagcaagtctggatcaacggatccggaacaaattctctctataagacacgag
     M  Y  S  S  E  E  L  W  N  S  T  E  Q  V  W  I  N  G  S  G  T  N  F  S  L  G  R  H  E gacgatgaggaggaggagacaagatccttcttcaggatgcctggctgtccactgttcttctctctcatcatgctggtgggactggtggga
 D  D  E  E  E  G  D  K  H  P  F  F  T  D  A  W  L  V  P  L  F  F  S  L  I  M  L  V  G  L  V  G actcctggtcattatgtcattcaaaaacgacagtgaggacggaaccaacttctacatacaaactggcgcgactgactatcttctggt
 N  S  L  V  I  Y  V  I  S  K  H  R  Q  M  R  T  A  T  N  F  Y  I  A  N  L  A  A  T  D  I  I  F  L  V gtgctgggccctttcaccgccaccttgtaccctcttccggatggatcttttggaaactcatgtgcaaattgtgccttctgagggtgacgtg
 C  C  V  P  F  T  A  T  L  Y  P  L  P  G  W  I  F  G  N  F  M  C  K  F  V  A  F  L  Q  Q  V  T  V caagccacttgcatcaccctgactgctatgagtggagaccgtgttacgtacagttacccctaaatcctttgcacgaaccccaagtagcca
 Q  A  T  C  I  T  L  T  A  M  S  G  D  R  C  Y  V  T  Y  P  L  K  S  L  R  H  R  T  P  K  V  A tgattgtcagatttgcattggatcggttcttttcgtcctctctcaccaatttaatgtaccagcgtatagaggggtactggtacggccgaggca
 M  I  V  S  I  C  I  W  G  S  F  V  L  S  T  P  I  L  M  Y  Q  R  I  E  E  G  Y  W  Y  G  P  R  Q atactgcatggagagattccctaagcgcatggagggcttcatctgtaccagttcattgctgctactgctgcgtgtcactatctcttc
 Y  C  M  E  R  F  P  S  K  T  H  E  R  A  F  I  L  Y  Q  F  I  A  A  Y  L  L  P  V  L  T  I  S  F tgctacactctgatggttaagagggttggccagcccactgtagacctgtagacaataattctcaggtgaatctcctgtctgagagaacatcagatcc
 C  Y  T  L  M  V  K  R  V  G  Q  P  T  V  E  P  V  D  N  N  Y  Q  V  N  L  L  S  E  R  T  I  S  I gggagaaagttccagatggtgtagtgattgtgcttctttgccatgctgtgggggccatccagatcttgtcctcttccagtcttctatccaa
 R  S  K  V  S  K  M  V  V  V  I  V  L  L  F  A  I  C  W  G  P  I  Q  I  F  V  L  F  Q  S  F  Y  P  N ctaccagcctaactacgcaaatacaagtcaaggctggacacggatgtcttcaagccaactcctctgcaacccatagttatgcttcatgga
 Y  Q  P  N  Y  A  T  Y  K  I  K  T  W  A  N  C  M  S  Y  A  N  S  S  V  N  P  I  V  Y  G  F  M  G gctgatttccaaagtctttcaggaaaacttccttcctctgtttaagacaagtcagagcaagacatggctcaggactgcaatgctgagatta
 A  S  F  Q  K  S  F  R  K  T  F  P  F  L  F  K  H  K  V  R  D  S  S  M  A  S  R  T  A  N  A  E  I agttgttgctgcagaggagagcaacaataataacgcggtgaactgatcccgtcattaacataagaagataggacagttctctaatgagatcttg
 K  F  V  A  A  E  E  G  N  N  N  N  A  V  N     S  R  S  F  N  I  R  R  I  G  T  V  F   SEQ ID NO: 47 aaaaaaaaaaaaaaaa   SEQ ID NO: 48
```

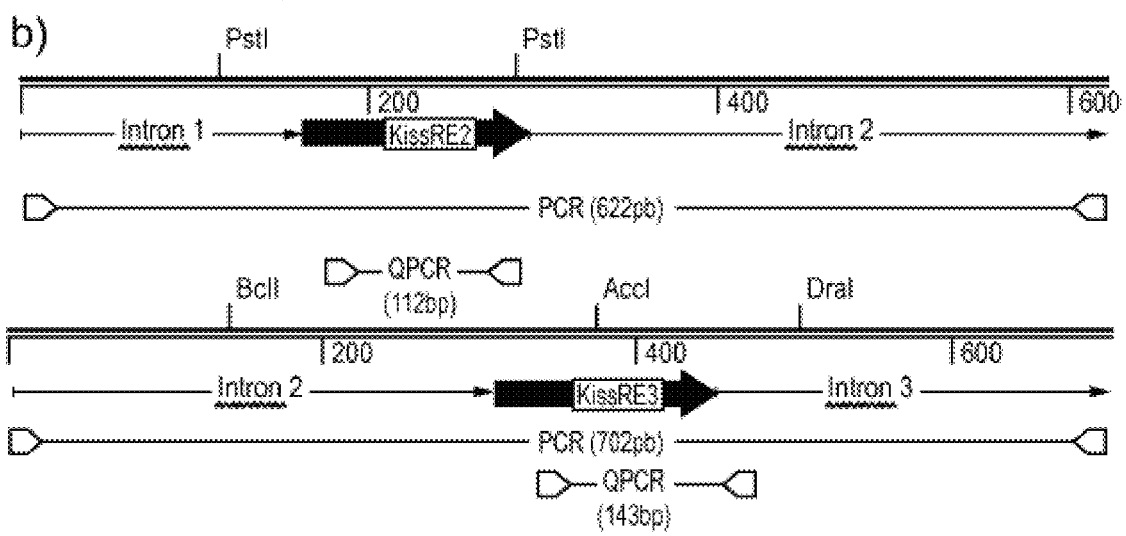

FIG. 57 a)
| | | |
|---|---|---|
| TTTCAACTACAACCCTCTCAGCCTTCGCTTTGGGAAACGCTACAATGGCTACATTTACA | Wild-type | SEQ ID NO: 49 |
| TTTCAACTACAACCCTCTCAGCCTTCGCTTTGGGAAACGCTACAATGGCTACATTTACA | +10 | SEQ ID NO: 50 |
| TTTCAACTACAACCCTCTCAGCCTTCGCTTTGGGAACGCTACAATGGCTACATT | +4 | SEQ ID NO: 51 |
| TTTCAACTACAACCCTCTCAGCCTTCGCTTTGGg---ACGCTACAATGGCTACATTTACA | -4 (-7,+3) | SEQ ID NO: 52 |
| TTTCAACTACAACCCTCTCAGCCT-----------ACGCTACAATGGCTACATTTACA | -11 | SEQ ID NO: 53 |
| TTTCAACTACAACCCTCTCAGCCT------------ACGCTACAATGGCTACATTTACA | -12 [x2] | SEQ ID NO: 54 |
| TTTCAACTACAACCCTCTCAGCCTT------------CGCTACAATGGCTACATTTACA | -12 [x5] | SEQ ID NO: 55 |
| TTTCAACTACAACCCTCTCAGCCTTCGCT------------ACAATGGCTACATTTACA | -12 | SEQ ID NO: 56 |
| TTTCAACTACGACCCTCTCAGCCTTCGCT------------CAATGGCTACATTTACA | -12 | SEQ ID NO: 57 |
| TTTCAACTACAACCCTCTCA------------------ACGCTACAATGGCTACATTTACA | -16 | SEQ ID NO: 58 | b)
| | | |
|---|---|---|
| GACAGTCTACCCCCTGAAATCTCTTCGGCACGACCCAAGTAGCCATGATTGTCAGCATT | Wild-type | SEQ ID NO: 59 |
| GACAGTCTACCCCCTGAAATCTCTTCGGCA---CCCAAAGTAGCCATGATTGTCAGCATT | -3 (-6,+3) | SEQ ID NO: 60 |
| GACAGTCTACCCCCTGAAATCTCTTCGGCA-----CCCAAAGTAGCCATGATTGTCAGCATT | -5 | SEQ ID NO: 61 |
| GACAGTCTACCCCCTGAAATCTCTTCGGC-------CCCAAAGTAGCCATGATTGTCAGCATT | -7 [x2] | SEQ ID NO: 62 |
| GACAGTCTACCCCCTGAAATCTCTTC----------CCCAAAGTAGCCATGATTGTCAGCATT | -10 | SEQ ID NO: 63 |
| GACAGTCTACCCCCTGAAATgtag--------------CCAAAGTAGCCATGATTGTCAGCATT | -14 (-18,+4) | SEQ ID NO: 64 |
| GACAGTCTACCCCC--------------------------AAAGTAGCCATGATTGTCAGCATT | -26 | SEQ ID NO: 65 |

FIG. 59

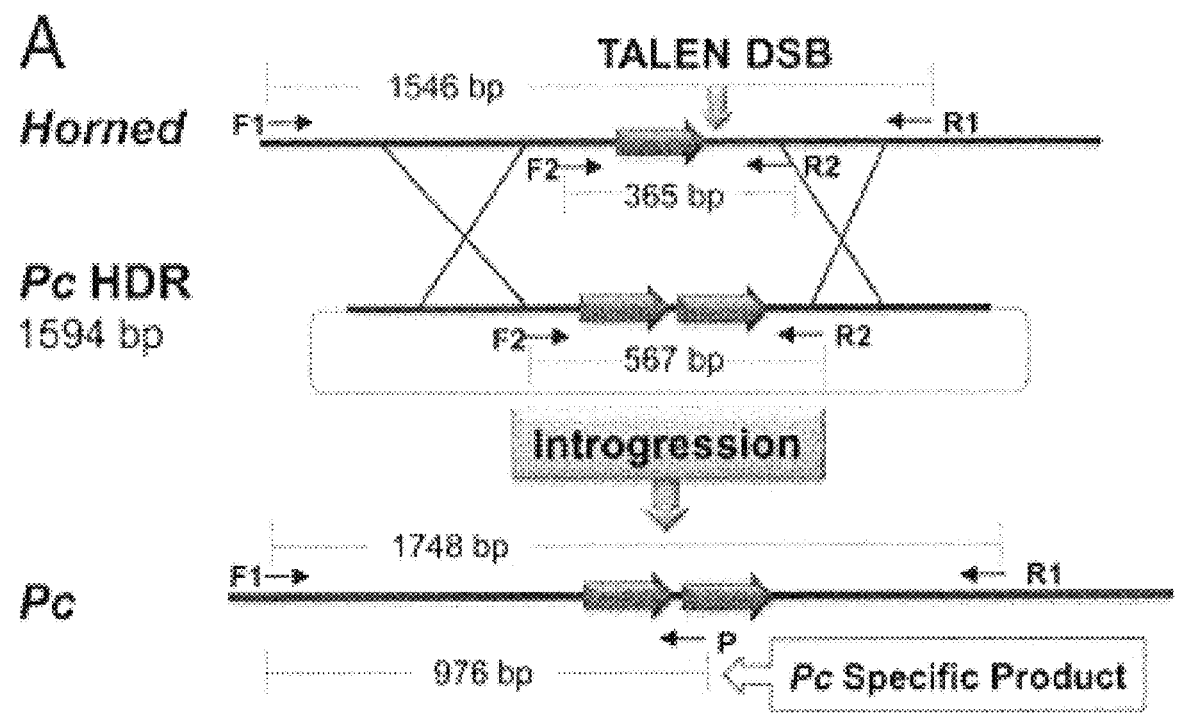
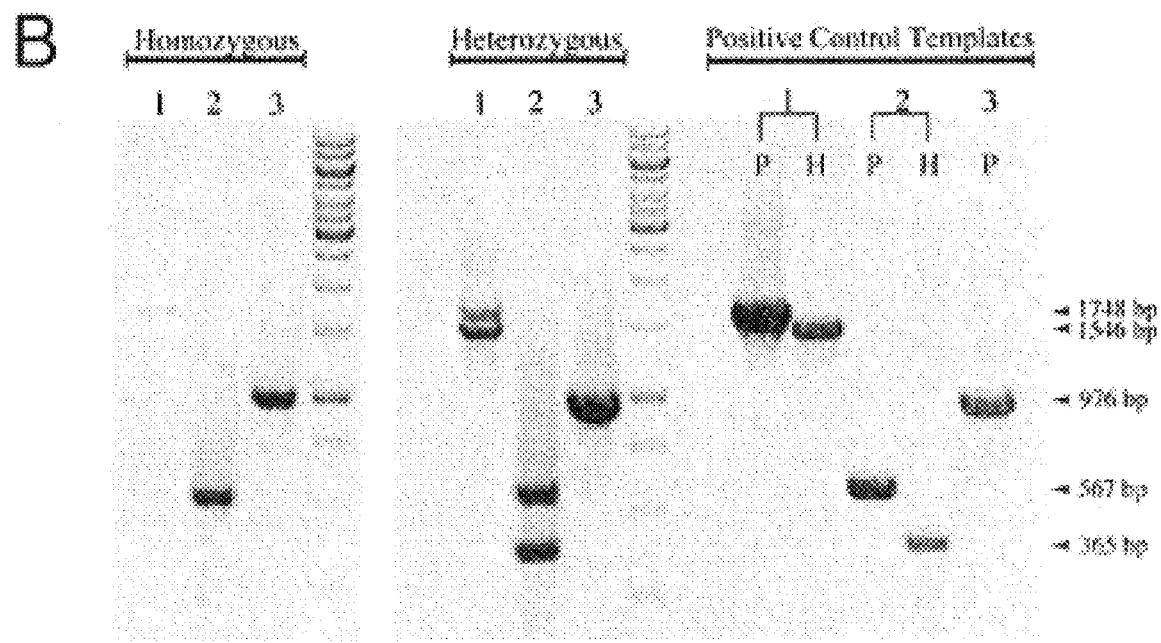
Fig. 62

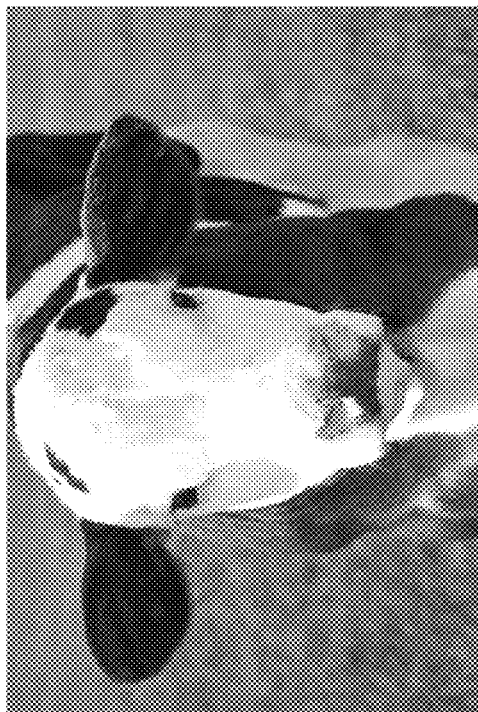
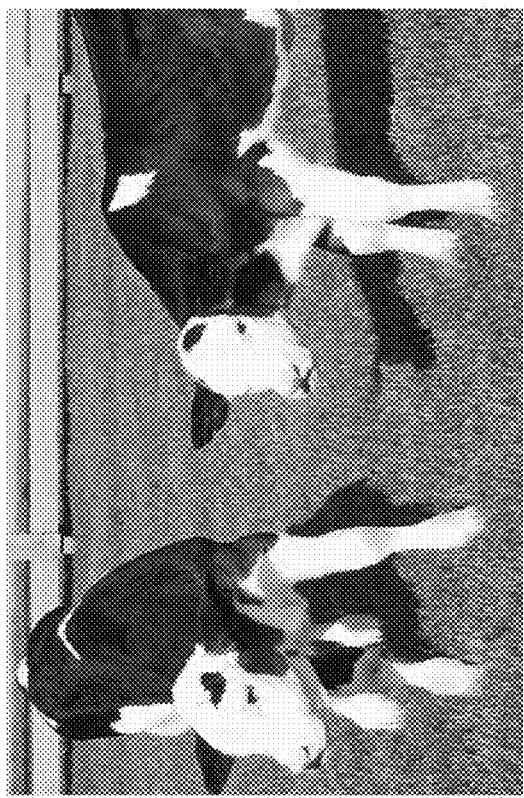
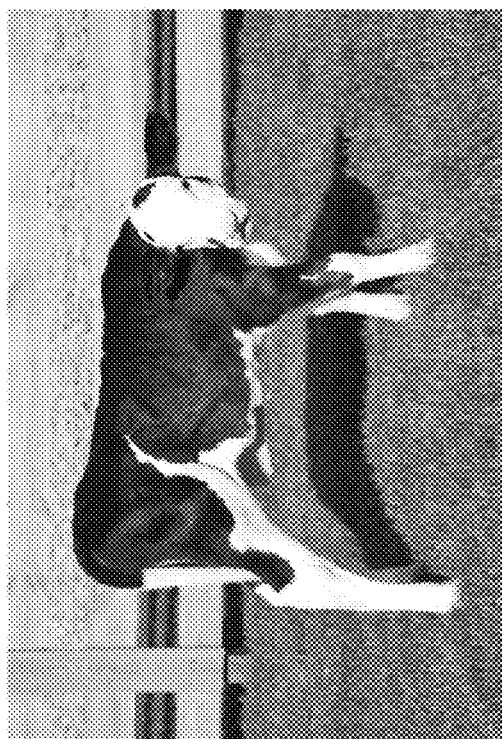
FIG. 68

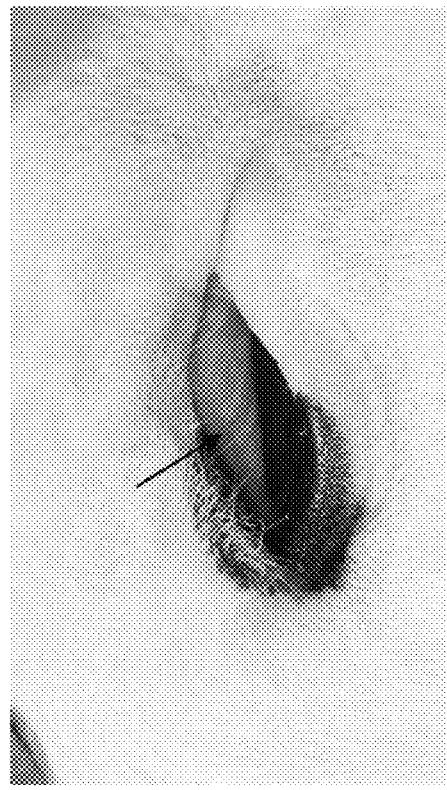
FIG. 69 atcgaacctgggtcttctgcattggctggcagattctttaccactgagccaccacaccctagagtgcaaaggggggcttagcaccacag gaggttcacaaagatgtaagctgttcttattaaggctgaggtgggggttgggagaagggggagaaaaagttttgtaagtgttaatttata ataaatccccaaagaaatggtctttcaagtacatacttatctaaaactttgtcataggggaaatgttcttaggagagaaaaggaattttt cttttagcataaagctgactttctaatatgggcttccctagtagctcagctggtgaagaacccgcctgcaatgtgggaaacctgggtttga gccctgggttgggaagatccctggagaaaagaatggctacccactccagtattctggcctggagaattccatggactgtataccatg gggttgcaaagagttggacacgactgagtgactttcattttcactttctgactttctaatattcgaggaatgcttagaagtgtggccggtaga aaatagtcctttgtgcctgggacttcaagaaggcggcactatcttgatggaactcagtctcatcacctgtgaaatgaagagtacgtggta ccaactactttctgagctcacgcacagctggacgtctgcgcctttcttgttatactgcagatgaaaacattttatcagatgtttgcctaagtat ggattacatttaagatacatattttctttcttgtctgaaagtctttgtagtgagagcaggctggaattatgtctggggtgagatagttttcttggt aggCTGGTATTCTgctctttagatcaaaactctcttttcattttaagtctatcccaaaagtgtgggaggtgtccttgatgttgaattat aggcagagggtcagtttatcaacacccaagaccaacatctctgcctttgataagagatagaaatagaagtggagagagaggagga aaaacatgactcacgatacattctgggttgtttgttttgtttttattttgtttggaaggagcgggtgggggaacgtgctgattaaagaaagt ctagagagaacaagattcttaaaaataaatccacagtgaagcccagcgggtggggatttcccacagattttcagggcttttttgtgttgtc atggggatattagtcaatgttggtgtcttattttggagtcactatgagtgaaccatgtttaaggagctatggctcagctgctaaactattttca aaaggaaaatggtgtgttacggtttccgagcagtggggccctggtacaggtaatatcatactcaaaagcactcttttgtgctacatgaat gaatcctgctaaaccatgcgga

FIG. 72

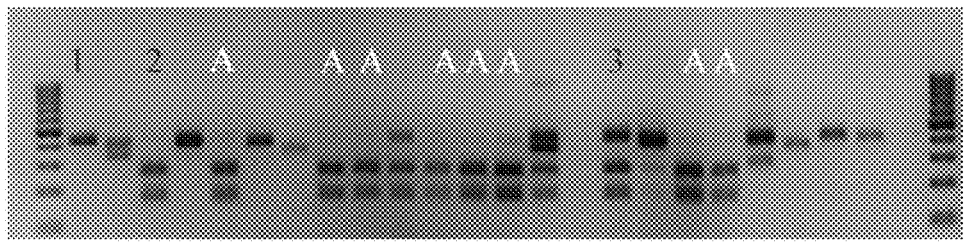

Individual colonies were propagated from the transfected populations above and subjected to RFLP analysis for identification of mutant colonies.
Three outcomes are apparent:
1: WT RFLP result
2: Mutant RFLP result. This population was sequenced and used in cloning of bi-allelic mutant animals.
3: Heterozygous RFLP result.
A: Other example mutant results. (These colonies were not used in cloning.)

FIG. 77

NON-MEIOTIC ALLELE INTROGRESSION

CROSS-REFERENCE

This application is a continuation application of U.S. application Ser. No. 16/424,356 filed May 28, 2019, which is a continuation-in-part of U.S. application Ser. No. 15/802,272, "Efficient Non-Meiotic Allele Introgression" filed Nov. 2, 2017, which is a divisional of U.S. application Ser. No. 14/625,797 filed Feb. 19, 2015, which is a continuation of U.S. patent application Ser. No. 14/263,446 filed on Apr. 28, 2014, now U.S. Pat. No. 9,528,124, which claims priority to U.S. Provisional Appl. No. 61/870,401 filed on Aug. 27, 2013. U.S. application Ser. No. 16/424,356 is a continuation-in-part of U.S. application Ser. No. 13/404,662, "Genetically Modified Animals and Methods for Making the Same" filed Feb. 24, 2012, which claims priority to U.S. Provisional Appl. No. 61/446,651 filed on Feb. 25, 2011. U.S. application Ser. No. 16/424,356 is a continuation-in-part of U.S. application Ser. No. 13/594,694, "Genetically Modified Animals and Methods for Making the Same" filed on Aug. 24, 2012, which claims priority to U.S. Provisional Appl. No. 61/662,767 filed on Jun. 21, 2012 and is a continuation-in-part of U.S. application Ser. No. 13/404,662, "Genetically Modified Animals and Methods for Making the Same", filed Feb. 24, 2012 which claims priority to U.S. Provisional Appl. No. 61/446,651 filed Feb. 25, 2011. U.S. application Ser. No. 16/424,356 is a continuation-in-part of U.S. application Ser. No. 14/067,634, "Control of Sexual Maturation in Animals" filed on Oct. 30, 2013, which claims priority to U.S. Provisional Appl. No. 61/870,510 filed on Aug. 27, 2013 and claims priority to U.S. Provisional Appl. No. 61/720,187 filed on Oct. 30, 2012. U.S. application Ser. No. 16/424,356 is a continuation-in-part of U.S. application Ser. No. 14/154,906, "Hornless Livestock" filed on Jan. 14, 2014 which claims priority to U.S. Provisional Appl. No. 61/752,232 filed Jan. 14, 2013 and claims priority to U.S. provisional Appl. No. 61/870,570 filed Aug. 27, 2013. Each of these applications is hereby incorporated by reference in its entirety.

STATEMENT AS TO FEDERALLY SPONSORED RESEARCH

This invention was made with government support under Grant number 1R41HL108440-01 awarded by the National Institutes of Health, Grant number 1R43RR033149-01A1 awarded by the National Institutes of Health and Biotechnology Risk Assessment Program, and competitive Grant number 2012-33522-19766 awarded by the USDA—National Institute of Food and Agriculture. The government has certain rights in the invention.

SEQUENCE LISTING

The instant application contains a Sequence Listing which has been submitted electronically in ASCII format and is hereby incorporated by reference in its entirety. Said ASCII copy, created on Sep. 10, 2019, is named 53545_746_301 SL.txt and is 863,665 bytes in size.

BACKGROUND OF THE INVENTION

Animal genetic engineering has traditionally been accomplished by random insertion of expression cassettes, which suffered from low efficiency, unpredictable expression, and/or the requirement of linked selection markers. In addition, there are numerous challenges in the livestock industry, such as the risks posed to humans by horned cattle, limited ability to control the size, weight or build of the livestock, limited thermoregulation, etc.

SUMMARY OF THE INVENTION

Disclosed herein is a method for altering the genome of an animal cell, the method comprising: identifying a target DNA region within the animal cell, the target region comprising a target cleavage site; contacting the animal cell with a targeted nuclease such that the nuclease cleaves the target DNA region at the target cleavage site, wherein the targeted nuclease comprises one or more binding domains that specifically bind to one or more sequences within the target DNA region. In some embodiments, the target region is from 10 nucleotides to 200 nucleotides in length, such as from 10 nucleotides to 100 nucleotides, from 10 nucleotides and 75 nucleotides, from 10 to 60 nucleotides, from 10 nucleotides to 50 nucleotides, from 10 to 30 nucleotides, from 30 nucleotides to 70 nucleotides, from 40 nucleotides to 60 nucleotides, or from 45 nucleotides to 55 nucleotides in length. The targeted nuclease can be selected from the group consisting of a transcription-activator-like effector nuclease (TALEN), a CRISPR-based nuclease (e.g., CRISPR/Cas9), and a zinc finger nuclease. The targeted nuclease can be a transcription-activator-like effector nuclease (TALEN). The TALEN can comprise a first peptide and a second peptide, wherein the first peptide and the second peptide are configured to bind to one another in a non-covalent fashion, and wherein the first peptide comprises a first binding domain fused to a first portion of a bipartite nuclease, and the second peptide comprises a second binding domain fused to a second portion of a bipartite nuclease. The bipartite nuclease can be a bipartite FokI nuclease. In some embodiments, contacting the animal cell with the targeted nuclease comprises delivering mRNA encoding the TALEN into the animal cell such that the mRNA is expressed to produce the TALEN within the cell. A nuclear localization signal can be coupled to the TALEN.

In some embodiments, mRNA is delivered into the animal cell by any one of: electroporation, transfection, lipofection, liposome, nucleofection, biolistic particle delivery, nanoparticle delivery, lipid transfection, electrofusion, or direct injection.

Contacting the animal cell with the targeted nuclease can comprise expressing the targeted nuclease from plasmid DNA inside the animal cell. The targeted nuclease can be a CRISPR-based nuclease. The targeted nuclease can be a zinc finger nuclease.

The method can be performed without introducing into the animal cell (1) a fluorescent marker gene or (2) a reporter gene that, when incorporated into chromosomal DNA of the cell, confers a trait on the cell that permits isolation by one or more survival selection criteria (e.g., survival in the presence of a small molecule). The animal cell can be an artiodactyl cell. The animal cell can be a cell of a livestock animal. The livestock animal can be selected from the group consisting of swine, cows, sheep, and goats. The animal cell can be an animal cell selected from the group consisting of cattle, swine, sheep, chicken, goats, rabbit, and fish. The animal cell can be a *bovine* cell or a porcine cell. The animal cell can be a primary somatic cell.

The method can further comprise cloning the primary somatic cell to produce one or more embryos; and implanting the one or more embryos into a surrogate mother. Cloning the primary somatic cell can comprise somatic cell nuclear transfer or chromatin transfer. The method can further comprise producing a gene-edited animal from the implanted embryo.

The animal cell can be a totipotent or pluripotent cell. The animal cell can be a cell from an embryo.

The method can further comprise implanting the embryo into a surrogate mother. The method can further comprise producing a gene-edited animal from the implanted embryo.

The targeted nuclease can cleave the target DNA region at or adjacent to a neuroendocrine gene involved in sexual maturation. The neuroendocrine gene can be selected from the group consisting of GPR54, KISS1, and GnRH11. The neuroendocrine gene of the resulting animal cell can be inactivated. Inactivation of the neuroendocrine gene can prevent natural sexual maturation. Inactivation of the neuroendocrine gene can involve insertion of a stop codon in a sequence of the neuroendocrine gene.

The method can further comprise administering a rescue agent to an animal that comprises or is derived from the animal cell such that the animal proceeds to sexual maturity. The rescue agent can comprise a gonadotropin or a gonadotropin analogue. The rescue agent can comprise kisspeptin.

The method can further comprise contacting the animal cell with a homology-dependent repair (HDR) template such that the HDR template is incorporated into genomic DNA of the animal cell, thereby altering the genome of the animal cell. Incorporation of the HDR template into the genomic DNA of the animal cell can result in an animal cell with an allele that is not present (or differs from the corresponding allele) in the animal cell prior to contacting the animal cell with the HDR template. Contacting the animal cell with an HDR template can comprise expressing a vector that encodes the HDR template within the animal cell. The incorporated allele can be identical to an allele from a first breed that differs from a corresponding allele of a second breed from which the animal cell was originally derived. The first breed can be Belgian Blue cattle and the second breed can be Wagyu cattle or Nelore cattle. The incorporated allele can be a myostatin allele that causes a double-muscling phenotype. The animal cell, after incorporation of the HDR template, can be homozygous for the allele. The animal cell, after incorporation of the HDR template, can be heterozygous for the allele. The allele can have an insertion or a deletion relative to a corresponding allele in the animal cell prior to contact with the targeted nuclease and incorporation of the HDR template. The allele can have a single nucleotide polymorphism relative to the corresponding allele in the animal cell prior to contact with the targeted nuclease and incorporation of the HDR template. The HDR template can comprise a first arm and a second arm, wherein the first arm is homologous to DNA on a first side of the target cleavage site and the second arm is homologous to DNA on a second side of the target cleavage site. The sequence of the homology-dependent repair template can be incorporated into the genomic DNA of the animal cell at a success rate of greater than 1%. The HDR template can be single-stranded DNA. The allele can be the polled allele. Incorporation of the HDR template into the animal cell can result in a cell that comprises a natural allele that differs from a corresponding native allele, wherein the natural allele is selected from CWC15, ApaF1, GDF8, IGF2, SOCS2, DGAT1, GHRHR, TP53, DAZL, APC, PTEN, RB1, Smad4, BUB1B, BRCA1, BRCA2, ST14, AKT1, EGF, EGFR, KRAS, PDGFRA/B, LDLR, ApoE, ApoB, NOD2, VANGL1, VANGL2, miR-145, BMP10, SOS1, PTPN11, Nrg1, Kir6.2, GATA4, Hand2, and HLA-DQA. The targeted nuclease can induce a double-strand break at the cleavage site.

The method can further comprise delivering a recombinase to the animal cell. The method can produce a cell. The method can produce an animal. The method can produce a descendant of the animal.

Disclosed herein is a method of modifying a *bovine* cell, the method comprising: contacting the *bovine* cell with a targeted endonuclease that targets and cuts a gene encoding the prolactin receptor; contacting the *bovine* cell with a homology-dependent repair template such that the template integrates into the genome of the *bovine* cell to encode a truncated prolactin receptor protein. The truncated prolactin receptor protein can be 461 amino acids in length. The targeted endonuclease can be selected from a zinc finger nuclease, a TAL effector nuclease (TALEN) and a CRISPR/Cas 9 nuclease. The targeted endonuclease can be a TAL effector nuclease (TALEN).

In one aspect, the TALEN has zero mismatches to a targeted region of the gene encoding the prolactin receptor. The method can further comprise contacting the *bovine* cell with a targeted endonuclease comprises expressing exogenous mRNA encoding a TAL effector nuclease (TALEN).

Disclosed herein is a method of genetically modifying a *bovine* cell, the method comprising: obtaining a *bovine* cell; and editing a horned gene of the *bovine* cell such that the horned gene is edited to a polled gene. The horned gene of the *bovine* cell can comprise a nucleotide sequence according to SEQ ID NO: 385 or a nucleotide sequence that has at least 95% sequence identity to SEQ ID NO: 385.

The polled gene can comprise the nucleotide sequence according to SEQ ID NO: 386 or a nucleotide sequence that has at least 95% sequence identity to SEQ ID NO: 386. The horned gene can comprise the nucleotide sequence of SEQ ID NO: 385 and the polled gene comprises the nucleotide sequence of SEQ ID NO: 386.

In another aspect, editing the horned gene does not involve meiotic introgression.

Editing the horned gene can comprise implementing CRISPR, zinc finger nuclease, meganuclease, or TALEN technology. Editing the horned gene can comprise contacting the *bovine* cell with a TALEN that targets the horned gene. Editing the horned gene can comprise introducing into the *bovine* cell a homology directed repair (HDR) template homologous to a portion of the horned gene. The TALEN can target the horned gene at a DNA target sequence according to any of SEQ ID NOs: 240, 347, 348, 149, 150, 151, 152 and 153.

In some embodiments, editing a horned gene of the *bovine* cell such that the horned gene is edited to a polled gene comprises a 202 bp insertion-deletion event.

The HDR template can comprise a nucleotide sequence of SEQ ID NO: 381. The TALEN can comprise an amino acid sequence according to SEQ ID NOS: 460-467. Editing the horned gene can comprise implementing CRISPR technology using guide RNA.

In one aspect the *bovine* cell, after editing, is heterozygous for the polled gene. Alternatively, the *bovine* cell, after editing, can be homozygous for the polled gene. The *bovine* cell can be a somatic *bovine* cell. The method can further comprise transferring a nucleus of the somatic *bovine* cell to an enucleated egg of the same species.

The method can further comprise producing an animal that is derived from the cell. The method can be used to produce a cell. The method can be used to produce an animal. The animal can comprise a polled phenotype. The method can be used to produce an animal and a descendant of the animal.

Described herein is a non-human animal made by a method of introgressing an allele or gene into chromosomal DNA of a non-human animal cell comprising introducing into a cell isolated from a non-human animal line: (i) a CRISPR/Cas endonuclease; (ii) a guide RNA (gRNA) comprising a spacer RNA sequence that interacts with a target sequence in the chromosomal DNA of the cell; (iii) a homology-directed repair (HDR) template DNA sequence encoding an allele or a gene flanked by sequences homologous to the target sequence in a chromosomal DNA of the cell; and (iv) cloning the cell; wherein said introducing alters the chromosomal DNA of the cell to have identity with the HDR template DNA sequence at the target sequence in the chromosomal DNA, thereby introgressing the allele or the gene into the chromosomal DNA of the cell, wherein the HDR template DNA sequence also comprises a DNA sequence encoding a mismatch in the target sequence that alters the interaction with the RNA spacer sequence of the gRNA, and wherein the mismatch is introduced into the chromosomal DNA of the cell and creates a sequence in the chromosomal DNA of the animal that is not found in the non-human animal line.

In one aspect, the mismatch creates a sequence in the chromosomal DNA of the animal that is not found in the same breed as the animal line. The mismatch can create a sequence that is not found in nature. The mismatch can comprise a substitution of a DNA base for a base that does not promote binding to the gRNA of a CRISPR/Cas. The substitution can comprise a 1 to 5 base pair substitution. The mismatch can comprise an insertion or a deletion of a DNA base. The mismatch can comprise an insertion of 1-5 DNA bases. The mismatch can comprise a deletion of 1-5 DNA bases.

In another aspect, the target sequence can encode at least a part of an endogenous allele, wherein the HDR template DNA sequence encodes a natural allele that is homologous to the endogenous allele flanked by sequences homologous to the target sequence in the chromosomal DNA of the animal, and wherein the natural allele replaces the endogenous allele. The target sequence can encode at least part of an endogenous allele that encodes a protein or is part of a locus associated with a trait, wherein the HDR template DNA sequence encodes a different allele that is homologous to the endogenous allele. In some embodiments, the HDR template can encode a locus (or a part thereof) that is associated with an enhancement of the trait flanked by sequences homologous to the target sequence in the chromosomal DNA of the cell, wherein the different allele replaces the endogenous allele, and wherein the trait is selected from the group consisting of: a horn growth trait, a meat trait, a meat production trait, a milk production trait, a dairy trait, and a disease resistance trait. The disease resistance trait can be selected from: a gene for resistance to African swine fever (P65/RELA): (a) genes that potential tumor growth (e.g., TP53, APC, PTEN, RB1, Smad4, BUB1B, BRCA1, BRCA2, ST14 or a combination thereof); (b) human oncogenes for animal models of cancer (e.g., AKT1, EGF, EGFR, KRAS, PDGFRA/B or a combination thereof); (c) genes in animal models for hypercholesterolemia (to induce atherosclerosis, stroke, and Alzheimer's disease models), e.g., LDLR, ApoE, ApoB or a combination thereof; (d) Inflammatory Bowel disease, e.g., NOD2; (e) spina bifida, e.g., VANGL1 and/or VANGL2; (f) pulmonary hypertension, e.g., miR-145; (g) genes for cardiac defects, e.g., BMP10, SOS1, PTPN11, Nrg1, Kir6.2, GATA4, Hand2, or a combination thereof and (h) celiac disease genes, e.g., HLA-DQA1.

The target sequence can encode at least part of an endogenous allele, wherein the HDR template DNA sequence encodes an allele that is homologous to the endogenous allele flanked by sequences homologous to the target sequence in the chromosomal DNA of the cell, and wherein the allele that is homologous to the allele replaces the endogenous allele, and wherein the allele that is homologous to the endogenous allele is from the same species of animal as the non-human animal line. The target sequence can encode at least part of an endogenous allele, wherein the HDR template DNA sequence encodes an allele that is homologous to the endogenous allele flanked by sequences homologous to the target sequence in the chromosomal DNA of the cell, and wherein the allele that is homologous to the endogenous allele replaces the endogenous allele, and wherein the allele that is homologous to the endogenous allele is not from the same breed of animal as the non-human animal line.

In one aspect, the cell is selected from the group consisting of a primary cell, a primary somatic cell, a zygote, a germ cell, a stem cell, an oocyte, and a sperm. CRISPR/Cas endonuclease can be introduced into the cell as mRNA. The cell can be homozygous for the allele or the gene introgression into the chromosomal DNA of the cell.

The non-human animal line can be selected from the group consisting of: a non-human vertebrate line, a non-human primate line, a swine line, a cattle line, horse line, sheep line, a goat line, an avian line, a chicken line, a rabbit line, a fish line, a dog line, and a cat line.

In another aspect, the target sequence encodes at least part of an endogenous allele, wherein the HDR template DNA sequence encodes an allele that is homologous to the endogenous allele flanked by sequences homologous to the target sequence in the chromosomal DNA of the cell, wherein the allele that is homologous to the endogenous allele replaces the endogenous allele, and wherein the mismatch comprises a single nucleotide polymorphism (SNP) that is located within the allele that is homologous to the endogenous allele. In another aspect, the target sequence encodes at least part of an endogenous allele, wherein the HDR template DNA sequence encodes an allele that is homologous to the endogenous allele flanked by sequences homologous to the target sequence in the chromosomal DNA of the cell, wherein the allele that is homologous to the endogenous allele replaces the endogenous allele, and wherein the mismatch consists of a SNP, that is located within the allele that is homologous to the endogenous allele. In yet another aspect, the target sequence encodes at least part of an endogenous allele, wherein the HDR template DNA sequence encodes an allele that is homologous to the endogenous allele flanked by sequences homologous to the target sequence in the chromosomal DNA of the cell, wherein the allele that is homologous to the endogenous allele replaces the endogenous allele, and wherein the mismatch comprises a plurality of SNPs that is located within the allele that is homologous to the endogenous allele. Alternatively, the target sequence can encode at least part of an endogenous allele, wherein the HDR template DNA sequence encodes an allele that is homologous to the endogenous allele flanked by sequences homologous to the target sequence in the chromosomal DNA of the cell, wherein the allele that is homologous to the endogenous allele replaces the endogenous allele, and wherein the mismatch consists of a plurality of SNPs that are located within the allele that is homologous to the endogenous allele. The allele can be a SNP.

Disclosed herein is a method of making a genetically modified animal, said method comprising: (i) exposing embryos or cells to an mRNA encoding a TALEN, with the TALEN specifically binding to a target chromosomal site in the embryos or cells, (ii) cloning the cells in a surrogate mother or implanting the embryos in a surrogate mother, with the surrogate mother thereby gestating an animal that is genetically modified without a reporter gene and only at the TALEN targeted chromosomal site. In one aspect, the method includes exposing the embryos to the TALEN without a reporter gene, with more than about 1% of the embryos incorporating the modification at the targeted chromosomal site. Alternatively, exposing the cells to the TALEN without a reporter gene, and cloning the cells, with more than 1% of the cloned cells providing animals incorporating the modification at the targeted chromosomal site. The cells can be primary somatic cells or stem cells. The cells can be cloned by somatic cell nuclear transfer or chromatin transfer. The gestated animal can be homozygous for the modification. The gestated animal can be a founder animal.

The above method can be used to prepare a genetically modified animal. The animal can be a founder animal.

The genetic modification can be chosen from the group consisting of an insertion, deletion, inversion or translocation. The TALEN can be a first TALEN and the targeted chromosomal site is a first site, with the method further comprising a second TALEN directed to a second targeted chromosomal site. The TALEN can be a right TALEN and further comprise a left TALEN that is introduced with the right TALEN.

In another aspect, the method comprises providing embryos having genetics known to be capable of expressing a set of traits and exposing the embryos to the TALEN without a reporter gene and screening the gestated animal for the modification and for expression of the set of traits. Alternatively, the method comprises exposing the cells to the TALEN without a reporter gene, creating colonies of clonal cells, and testing a subset of members of the colonies to identify colonies incorporating the modification at the targeted chromosomal site. Testing the subset of members of the colonies can be a destructive process. The testing process can be chosen from the group consisting of a nucleolytic assay, sequencing, PAGE, PCR, primer extension, or hybridization.

Alternatively, the method comprises exposing the embryos or cells to single stranded DNA (ssDNA) that contains an exogenous sequence, with the genetic modification comprising the exogenous sequence. The ssDNA can be introduced into the cell after a vector encoding a TALEN is introduced into the cell. The ssDNA can be introduced into the cell between about 8 hours and about 3 days after the vector expressing a TALEN is introduced into the cell. TALEN mRNA can be directly introduced into the cell at about the same time as the ssDNA.

The exogenous sequence can comprise an alternative allele for the TALEN targeted chromosomal site. The alternative allele can be linked to a quantitative trait or qualitative trait. Alternatively, the alternative allele can comprise a myostatin allele present in Belgian Blue cattle. The cell or embryo can belong to a first breed and the allele can belong to a second breed of the animal. The first breed can be Wagyu or Nelore cattle and the second breed can be Belgian Blue cattle, with the offspring being a Wagyu or Nelore calf.

The allele can be chosen from the group consisting of an insertion, a deletion, a polymorphism, and a single nucleotide polymorphism.

The alternative allele can provide for an enhanced livestock trait, and is chosen from the group consisting of a horn polled locus, a gene recessive for fertility defects, a gene for enhancing meat production, a gene for enhancing dairy production, a gene for resistance to African swine fever, and combinations thereof; or can provide for an animal model, and is chosen from the group consisting of a gene for reduction of animal size, a gene that potentiate tumor growth, an oncogene, hypercholesterolemia genes, an inflammatory bowel disease gene, a spina *bifida* gene, a pulmonary hypertension gene, a gene causing a cardiac defects, and a celiac disease gene.

The targeted chromosomal site can be chosen for a disruption of a gene, wherein the disruption of the gene comprises an insertion, deletion, or substitution of one or more bases in a sequence encoding the gene and/or a cis-regulatory element thereof.

The genetic modification can be chosen from the group consisting of an insertion, a deletion, a change to an exogenous nucleic acid sequence, an inversion, a translocation, a gene conversion to natural allele, a gene conversion to a synthetic allele, interspecies allele migration, intraspecies allele migration, and a gene conversion to a novel allele.

The method can further comprise delivering a recombinase to the cell or embryo. The TALEN mRNA can be directly introduced into the cell as mRNA. The direct introduction into the cell can comprise a method chosen from the group consisting of electroporation, transfection, lipofection, liposome, nucleofection, biolistic particles, nanoparticles, lipid transfection, electrofusion, and direct injection. The TALEN mRNA can be introduced into the cell as a plasmid that encodes the mRNA.

In another aspect the method comprises a cell, wherein the cell is a primary cell or stem cell and the method is performed without a selection step that requires either a positive or a negative survival selection criterion. The cell can be chosen from the group consisting of a livestock cell, an artiodactyl cell, a cultured cell, a primary cell, a primary somatic cell, a zygote, a primordial germ cell, a stem cell, and a zygote, or wherein the embryo is a blastocyst.

The gestated animal can be chosen from the group consisting of swine, cows, sheep, goats, chickens, rabbits, fish, zebrafish, dog, mouse, cat, mouse, rat, and laboratory animal.

Disclosed herein is a method of making a genetically modified non-human animal cell or embryo comprising exposing embryos or cells of the animal in vitro to an mRNA encoding a TALEN, with the TALEN specifically binding to a targeted chromosomal site in the embryos or cells, with the cells or embryos being genetically modified only at the targeted chromosomal site and with the method being performed without a reporter gene. The method can further comprise culturing the cells and isolating colonies of the cells. The method can be performed without additives that create a positive or a negative selection pressure to select genetically modified cells. The method can comprise exposing the embryos or cells of the animal in vitro to a single stranded DNA that contains an exogenous sequence. The method can result in the production of a cell.

Disclosed herein is a genetically modified animal, the animal being a founder comprising an exogenous nucleic acid sequence at an intended site and being free of all other genetic modifications. The exogenous nucleic acid sequence can be an allele and the intended site is a homologue of the allele. The animal can be homozygous for the allele.

Disclosed herein is a method of creating a genetic modification comprising exposing a non-human primary cell in an in vitro culture or a non-human embryo to a nucleic acid encoding a TALEN, wherein the nucleic acid encodes an N-terminal leader portion having at least 80% homology to SEQ ID NO:132. The N-terminal leader portion can have 80% homology to the 22-residue sequence portion of SEQ ID NO:132 and a total of no more than about 30 residues. The nucleic acid can have at least 90% homology to SEQ ID NO: 131.

Certain embodiments are directed to hypothermic conditions for use of targeting endonucleases. One aspect encompasses a hypothermic method of template-directed repair to change a chromosomal DNA of a cell, comprising introducing into a living cell a targeted nuclease system and a nucleic acid template, wherein the targeted nuclease system and the template operate to alter the chromosomal DNA to have identity to the template sequence wherein the living cell is maintained at a hypothermic culturing temperature below a physiological temperature for a time period of more than three days measured from the time of the introduction. A method of hypothermic template-directed repair may involve the hypothermic culturing increasing a stable incorporation of the template sequence into the chromosomal DNA. A method of hypothermic template-directed repair may further involve a culturing temperature kept within a range from 20 to 34° C. A method of hypothermic template-directed repair may further involve a time period of more than three days. The time period may range from more than three days to about two weeks. A method of hypothermic template-directed repair may further involve testing a cell for the template sequence. A method of hypothermic template-directed repair may further involve a targeted nuclease system comprising Cas9 and Clustered Regularly Interspaced Short Palindromic Repeats (CRISPR) or a plurality of TAL effector repeat sequences that are fused to the nuclease (TALEN). The targeted nuclease system may comprise Cas9 and Clustered Regularly Interspaced Short Palindromic Repeats (CRISPR) or a plurality of TAL effector repeat sequences that are fused to the nuclease (TALEN), wherein the nucleic acid guide is an ssDNA. A method of hypothermic template-directed repair may further involve one or more of a nuclease, a nucleic acid guide, and a nucleic acid template introduced into the cell as an mRNA. A method of hypothermic template-directed repair may further involve a cell selected from the group consisting of a primary cell, a primary somatic cell, an egg, a sperm, a zygote, a germ cell, a stem cell, an oocyte, a sperm, and an embryo. A method of hypothermic template-directed repair may further involve an animal homozygous for the template sequence.

Another aspect encompasses a method of template-directed repair to change a chromosomal DNA of a cell, comprising introducing into a living cell a targeted nuclease system, a nucleic acid template, and a cold-factor for inhibiting cell growth, wherein the targeted nuclease system and the template operate to alter the chromosomal DNA to have identity to the template sequence. The method of template-directed repair to change a chromosomal DNA of a cell may comprise a cold-factor for inhibiting cell growth, such as Cold-inducible RNA-binding protein (CIRP). See Nishiyama et al., J. Cell Biol., (1997):137(4):899-908. The method of template-directed repair to change a chromosomal DNA of a cell may comprise a cell-cycle inhibitor introduced by placement into a culture that comprises the cell. The cell-cycle inhibitor may be introduced as a protein, as RNA, as an mRNA, or through a vector encoding the cell-cycle inhibitor. The cell-cycle inhibitor may be introduced as a protein, as RNA, as an mRNA, or through a vector encoding the cell-cycle inhibitor wherein the template is a HDR template. The template may be ssDNA. One or more of the nuclease system and the nucleic acid template may be introduced into the cell as an mRNA. The cell may be selected from the group consisting of a primary cell, a primary somatic cell, a zygote, a germ cell, a stem cell, and an embryo. A genetically modified animal may be prepared according to the method of any of the above. A founder animal may be made by the method of any of the above. A cell may be made by the method of any of any of the above.

In another aspect, various allelic and genetic modifications are contemplated. For example, a modification comprises a nonhuman animal comprising a heritable exogenous allele that provides elevated fecundity and/or a heritable exogenous allele that provides parent-of-origin dependent muscle hypertrophy. The animal of may be a goat. The animal may be chosen from the group consisting of livestock, primate, swine, cattle, horse, sheep, goat, chicken, rabbit, fish, dog, mouse, cat, rat, and laboratory animal. The animal may be free of fluorescent markers, selectable markers, and expressible markers. The elevated fecundity allele of the animal may be FecB; BMPR-IB. The muscle hypertrophy allele of the animal may be Callipyge. The animal may be homozygous for the exogenous allele.

The animal may be a non-human animal comprising an exogenous allele for APC. The animal may comprise an allele directed to a cancerous phenotype. The exogenous allele may be a human allele. The animal may be a laboratory animal model. The animal may be selected from the group consisting of pig, miniature pig, Ossabow pig, rabbit, dog, sheep, and goat. The animal may be a founder. The animal may be free of chromosomal changes other than introgression of the exogenous allele. Disclosed herein is a method of making the animal of comprising an HDR templated introgression of the exogenous allele with a targeted nuclease system. The method of making the animal may comprise an HDR templated introgression of the exogenous allele with a targeted nuclease system wherein the exogenous allele is chosen to be a human allele that is associated with a cancerous phenotype.

Another aspect is an animal comprising an exogenous allele selected from Table 7 entitled "Frequencies for recovery of colonies with HDR alleles". Also disclosed is a method for creating the animal comprising introgressing an allele into an animal, the allele being chosen from the group listed on said Table 7 or as follows. The allele may be LDLR, e.g., for cholesterol modeling. The allele may be DAZL, e.g., for sterility. The allele may be APC, e.g., for cancer modeling. The allele may be p53. The allele may be RAG2, e.g., knocked-out for immunosuppression. The allele may be IL-2, e.g., knocked-out for immunosuppression (not in Table). The allele may be a double knock-out of RAG2 and Il-2 for immunosuppression (not in Table). The allele may be ROSA, e.g., for a safe harbor. The allele may be SRY, e.g., for modifications to a Y chromosome, for sex selection; —is KISS OR KISSR, e.g., for maturation or prevention thereof, e.g., knockout. The allele may beGDF8, e.g., for increasing muscling in animals. The allele may be EIF4G, e.g., for resistance to foot and mouth diseases (FMDV). The allele may be p65 for resistance to African Swine Fever. The allele may becaFecB for twinning, including interspecies introgression. The allele may be Diglyceride acyltransferase (DGAT) knockout for increased dairy merit.

The allele may be ATP-binding cassette sub-family G member 2 (ABCG2) for increased dairy merit. The allele may bepleiomorphic adenoma gene 1 (PLAG1) for influencing age at puberty, stature and body weight. The allele may be Beta lactoglobulin for reducing allergenicity of milk, is ovomucoid, ovalbumin, ovotransferrin, or lysozyme for reducing allergenicity of avian eggs. The animal may be a pig, sheep, goat, or cow with an introgressed allele. Disclosed herein is a cell or an animal comprising any of the above modifications. The cell or animal may be a vertebrate, livestock, primate, swine, cattle, horse, sheep, goat, chicken, rabbit, fish, dog, mouse, cat, rat, or laboratory animal.

Another aspect is a method of creating a single nucleotide polymorphism (SNP) in a chromosomal DNA of a cell, comprising introducing a targeted nuclease system and a HDR template into the cell, with the targeted nuclease system comprising a DNA-binding member for specifically binding an endogenous cognate sequence in the chromosomal DNA, wherein the targeted nuclease system and the HDR template operate to alter the chromosomal DNA to have identity to the HDR template sequence, wherein the HDR template sequence comprises a SNP. The HDR template sequence may comprise a plurality of SNPs. The HDR template sequence may comprise an exogenous allele that replaces an endogenous allele, with the exogenous allele comprising an SNP in a sequence alignment with the endogenous allele. The HDR template sequence may comprise a plurality of SNPs wherein the HDR template sequence comprises an exogenous allele that replaces an endogenous allele, with the exogenous allele comprising an SNP in a sequence alignment with the endogenous allele. The method may produce a modification wherein the chromosomal DNA is free of SNPs outside of the exogenous allele. The method of any of the above being free of SNPs outside of the exogenous allele with the HDR template sequence being identical to the chromosomal DNA except for one or more SNPs in the exogenous allele. The method of any of the above being free of SNPs outside of the exogenous allele with the HDR template sequence being identical to the chromosomal DNA except for one or more SNPs in the exogenous allele wherein there is only one SNP. The method of any of the above wherein the HDR template is designed to reduce specific binding of the DNA-binding member to the HDR template sequence and the HDR template sequence comprises a SNP, as aligned with the chromosomal DNA.

Further disclosed herein is a genetically modified animal from a first breed comprising an allele of a gene selected from another species or another breed; wherein the animal of the first breed is free of genetic changes other than the allele; methods of making the animal as set forth herein.

Another aspect of the present invention is a method of homology-directed repair (HDR) to introgress an exogenous allele into chromosomal DNA of a cell, comprising introducing a targeted endonuclease system and a HDR template that comprises the exogenous allele into the cell, with the targeted nuclease system comprising a DNA-binding member for specifically binding an endogenous cognate sequence in the chromosomal DNA, wherein the targeted nuclease system and the HDR template operate to alter the chromosomal DNA to have identity to the HDR template sequence to introgress the exogenous allele into the chromosomal DNA in place of an endogenous allele, with the targeting endonuclease system and/or HDR template comprising a feature to reduce specific binding of the targeting endonuclease system to DNA. The method of may comprise a feature to reduce specific binding comprising a mismatch in the DNA-binding member sequence relative to the endogenous cognate sequence and/or a mismatch in the DNA-binding member sequence relative to the HDR template sequence. The targeted endonuclease system may comprise a plurality of TAL effector repeat sequences that are fused to a nuclease (TALEN), with the TALEN comprising a sequence of Repeat Variable Diresidues (RVDs) and the mismatch is in the sequence of RVDs relative to the endogenous cognate sequence. The targeted nuclease system may comprise a Cas9 nuclease and a guide RNA, with the mismatch being in the gRNA sequence relative to the endogenous cognate sequence. The targeted endonuclease system may comprise a plurality of TAL effector repeat sequences that are fused to a nuclease (TALEN), with the TALEN comprising a sequence of Repeat Variable Diresidues (RVDs) and the mismatch is in the sequence of RVDs relative to the HDR template sequence. The targeted nuclease system may comprise a Cas9 nuclease and a guide RNA, with the mismatch being in the gRNA relative to the HDR template sequence. The exogenous allele may be a natural allele and the HDR template may comprise the mismatch, with the mismatch creating a sequence that is not found in nature. The exogenous allele may be free of mismatches and comprise DNA expressed by the cell. The exogenous allele may comprise the mismatch and DNA expressed by the cell. The method may further comprise selecting the DNA-binding member sequence and the endogenous cognate sequence so that altering the chromosomal DNA to have identity to the HDR template sequence creates the mismatch in the DNA-binding member sequence relative to the altered chromosomal DNA sequence. The exogenous allele may be a natural allele and the HDR template consists of the natural allele and DNA that has an identity with the chromosomal DNA sequence. Selecting the DNA-binding member sequence and the endogenous cognate sequence may further comprise placing a second mismatch in the endogenous cognate sequence that is not changed when the chromosomal DNA is altered to have identity to the HDR template. The method may further comprise selecting the DNA-binding member sequence and the endogenous cognate sequence to place the mismatch in the endogenous cognate sequence relative to the DNA-binding sequence, and altering the chromosomal DNA to have identity to the HDR template sequence does not remove the mismatch. The mismatch may comprise an insertion, a deletion, or a substitution. The insertion, deletion, or substitution may have a length from 1 to 20 residues. The insertion, deletion, or substitution may have a length from 1 to 20 residues. The mismatch may be one SNP. The method may comprise a plurality of mismatches. The targeting endonuclease system may comprise a pair of TALENs that localize to the chromosomal DNA with a spacer sequence between the pair, wherein the feature comprises selecting the HDR template to create a change in a length of the spacer sequence to block cleavage of the DNA by the TALENs pair. The spacer length may be decreased by a deletion or increased by an insertion. The spacer length may be increased or decreased by a number of residues in a range from 1 to 60. The cell may be selected from the group consisting of a primary cell, a primary somatic cell, a zygote, a germ cell, a stem cell, an oocyte, a sperm, and an embryo. The HDR template may be a ssDNA. The nuclease system may be introduced into the cell as an mRNA. The targeted nuclease system may specifically bind the endogenous cognate sequence with a binding protein. The exogenous allele may comprise an APC allele. The method of any of the above may be free of reporters, fluorescent markers, selectable markers, and expressible markers. The cell may be a livestock cell. The cell may be from vertebrate, livestock, primate, swine, cattle, horse, sheep, goat, chicken, rabbit, fish, dog, mouse, cat, rat, and laboratory animal. The animal may be homozygous for the exogenous allele. Disclosed herein is a method of making a genetically modified animal comprising cloning a cell modified by the method of any of the above. The animal may be a founder. Disclosed herein is a genetically modified animal prepared according to the method of any of the above. The genetically modified animal may be a founder animal. Disclosed herein is a cell made by the method of any of the above. Disclosed here in is a kit comprising the targeted nuclease system and the HDR template of any of the above. Disclosed herein is a use of any of the above comprising preparing a cell for research in vitro, or preparing a cell for use in making an animal.

Another aspect comprises a genetically modified animal, the animal belonging to a breed having an endogenous allele in the chromosomal DNA of the animal, the animal comprising a change at an SNP, the SNP being in the endogenous allele relative to an exogenous allele found in another species or another breed of animal. The genetically modified animal may belong to a breed having an endogenous allele in the chromosomal DNA of the animal, the animal comprising an exogenous allele found in another species or another breed of animal, with the exogenous allele having a change at an SNP relative to the endogenous allele. In other words, the modified animal has an SNP so that it now has an allele that is not normally found in its breed, with that allele being from some other breed or species. The change could be only that SNP or there could be other changes, with the SNP being necessary to mirror the desired allele. The SNP is not a result of random processes, but is an intended result. The animal may comprise a plurality of the SNPs. The animal may comprise further changes in the chromosomal DNA of the animal relative to the exogenous allele. The animal of any of the above being free or reporters. The animal of any of the above being homozygous for the SNP and/or the SNPs. The animal of any of the above being from vertebrate, livestock, primate, swine, cattle, horse, sheep, goat, chicken, rabbit, fish, dog, mouse, cat, rat, and laboratory animal.

Another aspect comprises a method of creating a landing pad in a chromosomal DNA of a cell, comprising introducing a targeted nuclease system and a HDR template into the cell, with the targeted nuclease system comprising a DNA-binding member for specifically binding an endogenous cognate sequence in the chromosomal DNA, wherein the targeted nuclease system and the HDR template operate to alter the chromosomal DNA to have identity to the HDR template sequence, wherein the HDR template sequence comprises a landing pad.

Also disclosed herein is a genetically modified livestock animal comprising a genome that comprises inactivation of a neuroendocrine gene selective for sexual maturation, with the inactivation of the gene preventing the animal from becoming sexually mature. Inactivation of the gene may comprise an insertion, deletion, or substitution of one or more bases in a sequence encoding the sexual maturation gene and/or a cis-regulatory element thereof. The inactivated gene may be inactivated by: removal of at least a portion of the gene from a genome of the animal, alteration of the gene to prevent expression of a functional factor encoded by the gene, or a trans-acting factor. The gene may be inactivated by the trans-acting factor, said trans-acting factor being chosen from the group consisting of interfering RNA and a dominant negative factor, with said trans-acting factor being expressed by an exogenous gene or an endogenous gene. The trans-acting factor may comprise a dominant negative for GPR54. Inactivation of the gene may be under control of an inducible system. The inducible system may comprise a member of the group consisting of Tet-On, Tet-Off, Cre-lox, and Hif1 alpha. The animal may be chosen from the group consisting of cattle, swine, sheep, chicken, goats, and fish. Further disclosed is a livestock animal of any of the above wherein the sexual maturation gene is chosen from the group consisting of Gpr54, Kiss1, and GnRH11. The livestock animal may further express a trait as a result of expression of a recombinant protein. The livestock animal may express an exogenous recombinant protein. The trait may be chosen from the group consisting of production traits, type traits, and workability traits. The livestock animal of any of the above may be sexually immature at an age that a wild type animal of the same species is sexually mature. The livestock animal of any of the above may be genetically unable to mature without a treatment.

Further disclosed herein is a genetically modified livestock animal comprising a genome that is heterozygous for an inactivation of a neuroendocrine gene selective for sexual maturation, wherein progeny homozygous for the inactivated gene are thereby prevented from becoming sexually mature. The sexual maturation gene may be chosen from the group consisting of Gpr54, Kiss 1, and GnRH11.

Another aspect comprises an in vitro organism chosen from the group consisting of a cell or an embryo, the in vitro organism comprising a genome that comprises an inactivation of a sexual maturation gene. The organism may be a cell or embryo chosen from the group consisting of cattle, swine, sheep, chicken, goats, rabbit, and fish. The inactivation may be in a gene chosen from the group consisting of Gpr54, KiSS1, and GnRH11.

Another aspect comprises a process of making a livestock animal comprising introducing, into an organism chosen from the group consisting of a livestock cell and a livestock embryo, an agent that specifically binds to a chromosomal target site of the cell and causes a double-stranded DNA break to inactivate a neuroendocrine gene selective for sexual maturation, with the agent being chosen from the group consisting of a TALEN, a zinc finger nuclease, Cas9/CRISPR and a recombinase fusion protein. The agent may be a TALEN of a TALEN pair that comprises a sequence to specifically bind the chromosomal target site, and creates the double stranded break in the gene or creates the double stranded break in the chromosome in combination with a further TALEN that creates a second double stranded break with at least a portion of the gene being disposed between the first break and the second break. The process may further comprise co-introducing a recombinase into the organism with the TALEN or TALENs. A transgene expressing the agent may be placed in a genome of the organism Introducing the agent into an organism may comprise a method chosen from the group consisting of direct injection of the agent as peptides, injection of mRNA encoding the agent, exposing the organism to a vector encoding the agent, and introducing a plasmid encoding the agent into the organism. Further disclosed is the process of any of the above wherein the agent is the recombinase fusion protein, with the process comprising introducing a targeting nucleic acid sequence with the fusion protein, with the targeting nucleic acid sequence forming a filament with the recombinase for specific binding to the chromosomal site. The recombinase fusion protein may comprise a recombinase and Gal4. The process of any of the above may further comprise introducing a nucleic acid into the organism, wherein the nucleic acid is inserted into the genome of the organism at a site of the double-stranded break or between the first break and second break. The process of any of the above may further comprise introducing an exogenous nucleic acid template having a sequence into the organism, with the genome of the organism at a site of the double-stranded break receiving the sequence. The exogenous template can be copied or actually inserted into the genome, with the result being the same, regardless of the theories about it being one or the other mechanism. The result may be that the genome has the sequence of the template. The nucleic acid may comprise a member of the group consisting of a stop codon, a reporter gene, and a reporter gene cassette. The process of any of the above may further comprise cloning the animal from the organism. The animal may be chosen from the group consisting of cattle, swine, sheep, chicken, goats, rabbit, and fish. The sexual maturation gene may be chosen from the group consisting of Gpr54, Kiss1, and GnRH11. Inactivation of the gene may be under control of an inducible system.

Disclosed herein is a process of raising a livestock animal comprising administering an agent to an animal for sexual maturation of the animal, with the agent compensating for a genetic inability of the animal to sexually mature. The agent may comprise a gonadotropin or a gonadotropin analogue. The process may further comprise breeding the sexually mature animal to produce progeny. The genetic inability of the animal to mature may be a result of a genetically inactivated neuroendocrine gene selective for sexual maturation, hereafter variation 1. The inactivated gene may be chosen from the group consisting of Gpr54, Kiss1, and GnRH11. The inactivated gene may be inactivated by: removal of at least a portion of the gene from a genome of the animal, alteration of the gene to prevent expression of a functional factor encoded by the gene, or a trans-acting factor. The animal may be chosen from the group consisting of cattle, swine, chicken, sheep, fish, rabbit, and goats. The administration of the agent to the animals may take place in a treatment facility. The progeny may be distributed from the treatment facility to a plurality of locations to be raised.

INCORPORATION BY REFERENCE

All publications, patents, and patent applications mentioned in this specification are herein incorporated by reference to the same extent as if each individual publication, patent, or patent application was specifically and individually indicated to be incorporated by reference, including U.S. application Ser. No. 14/154,906 "Hornless Livestock," U.S. Prov. Appl. No. 61/870,570 "Hornless Livestock", U.S. Prov. Appl. No. 61/752,232 "Hornless Livestock", U.S. application Ser. No. 13/594,694 "Genetically Modified Animals and Methods for Making the Same," U.S. Prov. Appl. No. 61/662,767, U.S. Prov. Appl. No. 61/446,651, U.S. application Ser. No. 13/404,662, U.S. Prov. Appl. No. 61/870,510, U.S. Prov. Appl. No. 61/720,187, and Ser. No. 14/067,634 "Cells with Modified Neuroendocrine Genes."

BRIEF DESCRIPTION OF THE DRAWINGS

Various features of the disclosure are set forth with particularity in the appended claims. A better understanding of the features and advantages of the present invention will be obtained by reference to the following detailed description that sets forth illustrative embodiments, in which principles of the invention are utilized, and the accompanying drawings of which:

FIG. 4: Deletions and insertions sequenced from *bovine* embryos treated with ACAN12 TALENs. The wild-type sequence is shown with TALEN binding sites underlined. Both deletion and insertion events are identified.

FIG. 6: Deletions and insertions sequenced from cells treated with ACAN12 TALENs are shown in SEQ ID NO: 27-38. The wild-type ACAN12 sequence (SEQ ID NO. 26) is displayed in italics and the left and right (complimentary) TALEN-recognition sequences are underlined. Inserted nucleotides are highlighted in boxes and mismatch nucleotides are denoted by lower-case text.

FIG. 8B: Sequence comparisons of wild-type and bi-allelic clones with homozygous indels, as in FIG. 8A.

FIG. 9A: DMD (Duchenne's Muscular Dystrophy) Bi-allelic modification alleles. Colonies with either homozygous modification alleles (i.e., both alleles harbor the same mutation) or bi-allelic mutation with different mutations on each allele are displayed. For colonies with two indels, the number of times each allele was sequenced is displayed on the right. In some cases, a third mutation or single wild-type allele was sequenced, indicating that not all colonies are 100% clonal. Frame-shift alleles are indicated and mismatch nucleotides are denoted by lower-case text.

FIG. 9B: LDLR bi-allelic modification alleles, with notations as in FIG. 9A.

FIG. 11: DMD deletion sequences. DMD deletion junctions from replicate transfections are displayed. Above, exons 6 and 7 sequences are shaded, and TALEN-recognition sites are underlined. Inserted nucleotides are shaded.

FIG. 12: DMD inversion sequences. A schematic of the DMD inversion allele is shown with the 5' and 3' junctions (boxed) that were analyzed by sequencing. Below, the predicted sequence for each fusion is shown corresponding fusion at the center of each spacer for the TALEN pairs. TALEN-recognition sites are underlined. Sequenced inversion alleles from a transfected population are shown. The number of times each allele was sequenced is indicated at the right and inserted nucleotides are underlined. Mismatched nucleotides are denoted as lower-case text.

FIG. 16: Detailed sequence information for the Carlson +63 scaffold of FIG. 5 and comparison to an alternative scaffold used by Sangamo Biosciences.

FIG. 17: Detailed nucleic acid sequence for the vector used to make the Carlson +63 scaffold of FIG. 5, including non-translated portions.

FIG. 19: Use of single stranded oligonucleotides (ssOligos) as a template for homologous recombination at the *bovine* GDF8 locus. TALENs (btGDF83.1, arrow) and two ssODNs were designed to introduce an 11 bp deletion into exon-3 of the *bovine* GDF8 gene (Belgium Blue mutation) by homologous recombination. Each ssODN was 76 base pairs in length and were sense and antisense strands of the same target site Allele-specific PCR demonstrates that HDR induction is dependent on transfection btGDF83.1 TALENs and subsequent transfection of ssODNs using Lipofectamine LTX 24 hours later. The PCR assay was developed to specifically detect HDR modified GDF8 alleles using primers c and c' (shown panel a). The 3' end of primer c' spans the 11 bp deletion, and cannot amplify the wild type allele "WT". 1,000 cell equivalents were included in each PCR reaction and positive control reactions with the indicated copy number of a control template were used for comparative quantification of homologous recombination. BB-HDR Sense (S) has SEQ ID NO:133 and BB-HDR Anti (AS) has SEQ ID NO:134.

FIG. 24: Introgression of naturally occurring alleles from one species to another using mRNA encoded TALENs and ssODNs. The Piedmontese Myostatin allele C313Y was introgressed into Ossabaw fibroblasts by the methods of FIG. 25. The following ssODN was used ggccaattactgctctg-gagagtatgaattcgtattttacaaaaatacctcacactcatcttg (SEQ ID NO:146)

FIG. 27: TALENs mediate DSB in chicken cells and can stimulate homologous recombination in chicken primordial germ cells (PGCs). Panel a) TALEN activity was first determined in DF1 immortalized chicken cells line transfection and SURVEYOR assay. Panel b) Schematic depiction of the targeting strategy of the chicken ddx4 locus. The GFP/Puromycin reporter gene will replace the endogenous coding sequence in the second exon of targeted cells. Penal c) PGCs were transfected with the homologous recombination construct, TALENs (either Tal 1.1 or Tal7.1, empty vector) and a puromycin selection transposon. After selection in puromycin, GFP+ cells could be isolated when Tal 1.1 TALENs were used (right picture, left is bright field) but not with Tal7.1 TALENs or empty vector transfections.

FIG. 37B: A plot of experimental data generated to evaluate kinetics of TALEN induced HDR with oligonucleotide templates. Cells were transfected with either TALEN-encoding mRNA or plasmid DNA and oligos with 4 base pair insertions targeting LDLR or APC genes. Panel a) RFLP analysis on cell populations at indicated time points. Panel b) Results from panel a, were quantified by densitometry and the averages were plotted as a function of time with SEM (n=3). HDR signal first appears 12 hours post-transfection and accumulates over time.

FIG. 44: Experimental data for multiple SNPs placed in the TALEN DNA-binding site to stabilize HDR alleles in the EIF4GI gene. Panel a) shows a portion of wild type EIF4GI Wt-NL (SEQ ID NO:263) and a pair of TALENs (SEQ ID NOS: 264 and 265) designed to cut the wild type EIF4GI to stimulate homologous recombination. Also aligned to the Wt sequence is the core sequence (SEQ ID NO:266) of the donor oligo, DF-HDR, used to introduce three SNPs (underlined oversized letters) into the genome. The third SNP creates a novel EagI restriction site that was used for RFLP analysis. Pig fibroblasts were transfected with EIF4GI14.1 TALEN mRNA (2 μg) and DF-HDR (2 μM) and then cultured at 30° C. for 3 days prior to analysis and colony propagation. Panel b) shows RFLP analysis on population three days post transfection. Expected product sizes of 344, 177 and 167 bp are indicated by filled triangles. Panel c) shows RFLP assay on isolated cellular clones. Day 3 cells were used to derive monoclonal colonies through dilution cloning. An example of colonies with heterozygous (open triangles) or homozygous (filled triangles) HDR alleles are indicated.

FIG. 54 panel (B) discloses SEQ ID NOS 182-195, respectively, in order of appearance.

FIG. 55 panel a discloses SEQ ID NOS 196 and 519, respectively, in order of appearance. Panel b: 2 micrograms of TALENs encoding mRNA plus 0.2 nMol of the HDR template were transfected into pig fibroblasts that were grown as colonies and analyzed for homology dependent repair by HindIII RFLP assay. PCR results are shown; each lane represents one colony. Cleavage products of 231 and 158 bp are indicative of homology dependent repair. Colonies with the parent band of 389 bp are classified as heterozygous (open triangle) and those without are classified as homozygous (filled triangle) for the HDR, knockout allele.

FIG. 56: Panel a: Nucleotide and deduced translated amino acid sequence of mRNA encoding tilapia kisspeptin. The structural organization of the kiss gene is conserved and contains two coding exons, one encoding both the signal peptide and part of the kisspeptin precursor, the other encoding the remainder of the precursor including the kisspeptin-10 sequence. The position of the intron is indicated by a triangle glyph. The location of the forward and reverse primers for PCR amplification of the target region (442 bp) are shown. The binding sites for the two engineered pairs of TALENs, Kiss1.1a and Kiss1.1b are indicated in black and gray boxes. FIG. 56 panel a discloses SEQ ID NOS 198 and 564-565, respectively, in order of appearance. Panel b shows a schematic representation of the targeted kiss genomic region showing the location of the kisspeptin-10 biologically active peptide and each kiss1.1a and 1b TALENs recognition sites. PCR (442 bp) and qPCR primer pairs (138 bp amplicon) used for analysis of indels are shown as well.

FIG. 57: Panel a: Nucleotide and deduced translated amino acid sequence of mRNA encoding tilapia GPR-24 mRNA. The structural organization of the kissr gene is conserved and contains five coding exons. The positions of all four introns are indicated by a triangle glyph. The KissRE2 and KissRE3 TALENs targeted loci are located in the coding exon 2 (white boxes) and 3 (gray boxes) respectively. The location of the sense Left and antisense Right TALENs recognition sites are shown in boxes. FIG. 57 panel a discloses SEQ ID NOS 528-529 and 566, respectively, in order of appearance. Panel b shows a schematic representation of the tilapia GPR-24 genomic region showing the location of the introns (Stroked goalpost), the coding exons 2 and 3 (black arrows) containing the kissRE2 and RE3 loci (white boxes). The location primers used for PCR and qPCR analysis and the size of the corresponding amplicons are shown as well.

FIG. 59: Description of somatic mutations induced by engineered TALENs at the kiss gene (site kiss1.1a) (panel a) and kissR gene site (KissRE3) (panel b). The wild-type sequences are shown at the top of each panel with the sense left and antisense right TALEN recognition element sites shown in bold highlighted in dark gray and the sense spacer highlighted as underlined text. Deletions are shown as dashes and insertions as lower case letters highlighted in light gray. The net change in length caused by each indel mutation is to the right of each sequence (+, insertion; –, deletion). A few alterations have both a deletion and an insertion of sequence. The number of times each mutant allele was isolated is shown in brackets. FIG. 59 panel a discloses SEQ ID NOS 202, 530-532 and 206-211 and FIG. 59 panel b discloses SEQ ID NOS 212, 533, 214-216 and 534-535, all respectively, in order of appearance.

FIG. 60 panel a discloses SEQ ID NOS 219, 222, 220, 536 and 537, respectively, in order of appearance. Panel b: Description of all inherited indel mutations induced by engineered TALENs at the kiss gene (kiss1.1a site, top) and kissr gene (KissRE3 site, bottom). The wild-type sequences are shown at the top with the sense left and antisense right TALEN recognition elements shown in bold letter highlighted in dark gray and the sense spacer highlighted as underlined text. Deletions are shown as dashes. The net change in length caused by each indel mutation is to the right of each sequence (–, deletion). The number of times each mutant allele was isolated is shown in brackets. FIG. 60 panel b discloses SEQ ID NOS 202, 208, 226, 212, 228, 214, 230-232 and 538, respectively, in order of appearance. Panel c: Description of the most severe lesions found at the kiss and kissRE3 sites. The 18 nt deletion at the kiss1.1a loci result in the loss of 6AA (underlined) 3 of which are from the core sequence of the kisspeptin-10 active peptide (highlighted in gray). The 7 nt deletion at the kissRE3 loci (underlined text) result in significant alteration of the gene product with two AA substitution immediately followed by a stop codon. The resulting protein is C-terminally truncated by 215 AA. FIG. 60 panel c discloses SEQ ID NOS 234-237, 539 and 239, respectively, in order of appearance.

FIG. 62: TALEN-mediated introgression of POLLED. Panel A) A schematic of the strategy to introgress the Polled allele into Holstein (HORNED) cells. The POLLED allele, bottom, is a tandem repeat of 212 bp (red arrow) with a 10 bp deletion (not shown). TALENs were developed to specifically target the HORNED allele (green vertical arrow) which could be repaired by homologous recombination using the POLLED HDR plasmid. Panel B) Representative images of colonies with homozygous or heterozygous introgression of POLLED. Three primer sets were used for positive classification of candidate colonies: F1+R1, F2+R2 and F1+P (POLLED specific). Identity of the PCR products was confirmed by sequencing F1+R1 amplicons.

FIG. 68: Pictures of live POLLED Holstein calves.

FIG. 69: Pictures of a POLLED Holstein calf eye showing an extended eyelash length indicative of a homozygous POLLED phenotype.

FIG. 72: Chromosome 1: Celtic POLLED allele homology template. 202 bp POLLED allele present in Celtic Allele double underlined, 212 bp Horned allele (SEQ. ID NO: 526) includes underlined and double underlined sequence. The double underlined region is deleted to create POLLED allele. The 5' homology arm (before the double underlined sequence) is indicated by the box, 3' homology arm (after the double underlined sequence) is indicated by the box.

FIG. 73 discloses SEQ ID NOS 540-541, 394 and 542-547, respectively in order of appearance.

FIG. 74 discloses SEQ ID NOS 540-541 and 548-553, respectively, in order of appearance.

FIG. 75 discloses SEQ ID NOS 540-541 and 554-557, respectively, in order of appearance.

FIG. 77: Kiss Colony RFLP Image. Individual colonies were propagated from the transfected population above and subjected to RFLP analysis for identification of mutant colonies. Three outcomes were apparent: (1) Wild Type (WT) RFLP result, (2) Mutant RFLP result (this population was sequenced and used in bi-allelic mutant animals), (3) Heterozygous RFLP result. The letter A indicates another example mutant result which was not used in cloning.

FIG. 78 discloses SEQ ID NOS 393, 389 and 558-561, respectively, in order of appearance.

FIG. 81 discloses SEQ ID NOS 196 and 562-563, respectively, in order of appearance.

DETAILED DESCRIPTION OF THE INVENTION

Figure 1:
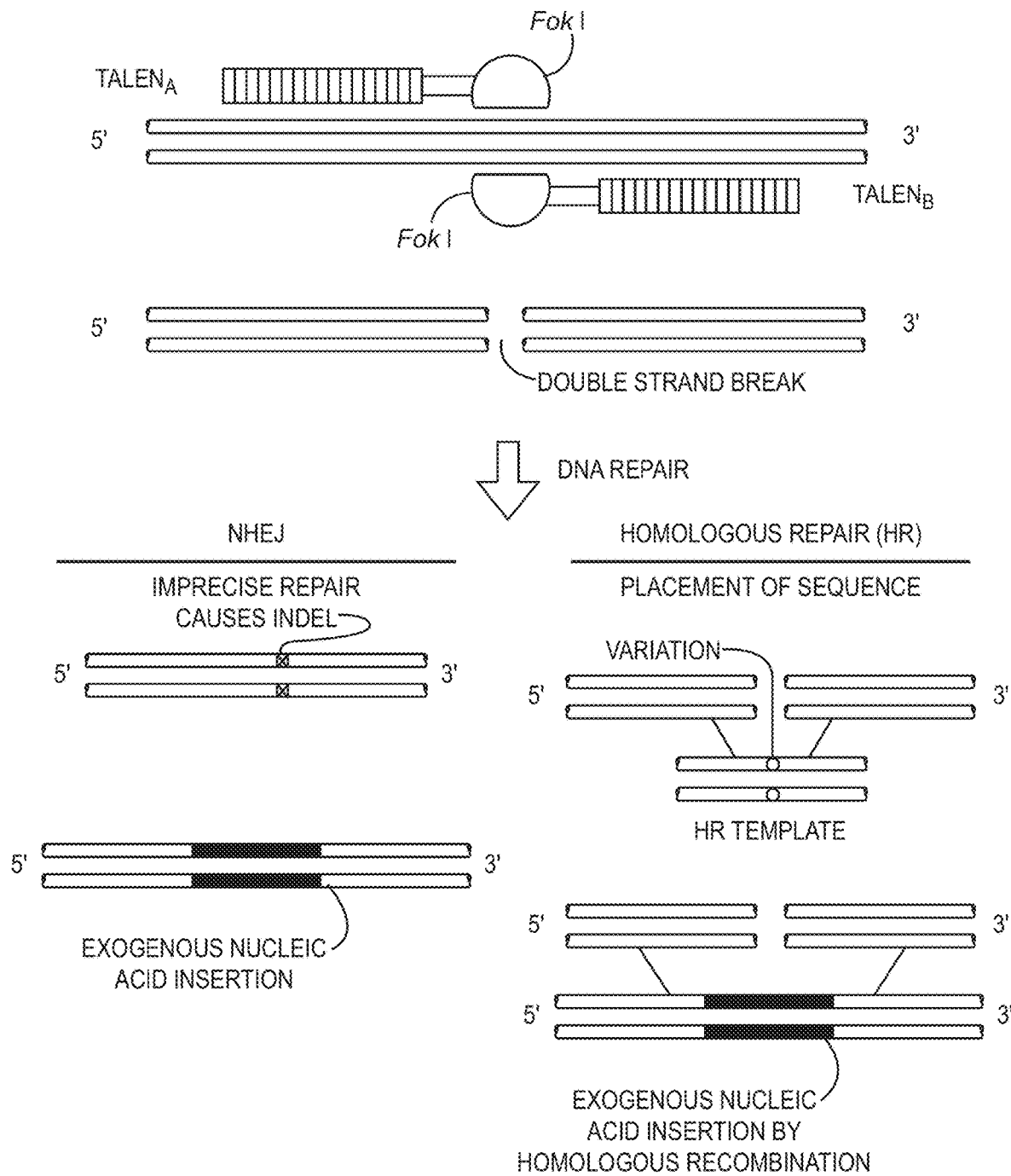
FIG. 1: An illustration of a TALEN and genetic modifications caused by the same.

The inventors have developed precise, high frequency editing of a variety of genes in various cells and/or animals that are useful for agriculture, for research tools, or for biomedical purposes. These livestock gene-editing processes include TALEN- and CRISPR/Cas-stimulated homology-directed repair (HDR) using plasmid, rAAV and oligonucleotide templates. Nucleases such as CRISPR/Cas, TALENs, and zinc finger nucleases are used to target specific nucleic acid sequences. Transcription activator-like (TAL) effector sequences can be assembled to specifically bind DNA targets by assembling sequences of repeat variable diresidues (RVDs). Fusion proteins of TAL effectors with a nuclease can make targeted double-stranded breaks in cellular DNA that can be used to make specific genetic modifications to cells.

Traditional breeding programs based on animal mating or artificial reproductive techniques involve mixing many genes in the hope of ultimately producing a good combination of genes that create or combine desirable traits. Transgenic techniques can accelerate traditional breeding processes. In some instances, however, transgenic processes while perhaps an overall improvement, are nonetheless slow, costly, and/or labor-intensive. Low efficiencies and unpredictability in results have slowed some efforts in the field. Further, in traditional breeding programs, processes that make a change only at a single intended genomic site are not available.

Gene editing tools such as targeting endonucleases are useful for making genetically modified animals. Using these tools to change a native allele at only one base is difficult or impossible using conventional processes. New techniques are described herein for making these edits at a single base, or a plurality of single-base edits. These processes are useful for introgression of an allele that differs only by a single nucleotide polymorphism (SNP) or a plurality of SNPs. The ability to introgress SNPs from one breed or species into another is believed to create important new opportunities. The term SNP refers to a difference of one base at the same relative site when two alleles are aligned and compared; herein, the term is also used in some contexts to mean a single base change.

Disclosed herein are processes to make transgenic animals that have changes only at an intended site. Additionally, the processes can make specifically intended changes at the intended site. In some instances, it is not necessary to remove other changes resulting from problems like the use of linked-reporter genes, or linked positive and negative selection genes, or random transgene integration, as the inclusion of such features are bypassed. Moreover, the processes can be used in the founder generation to make genetically modified animals that have only the intended change at the intended site. Other processes are also disclosed that involve unlinked marker genes and the like. Some embodiments use TALENs.

Compositions and methods of making higher animals, such as swine or cows, with genetic modifications are set forth herein. Some of these methods involve cloning from primary artiodactyl or other livestock cells. Further, methods for identifying cells or embryos that have been modified with TALENs are presented, as well as processes for enriching the percentage of TALEN-treated cells or embryos. Unexpectedly, it was observed that a genetic modification of one chromosome by a TALEN often caused the complementary locus of the other chromosome to also be modified by cellular machinery.

Figure 2:
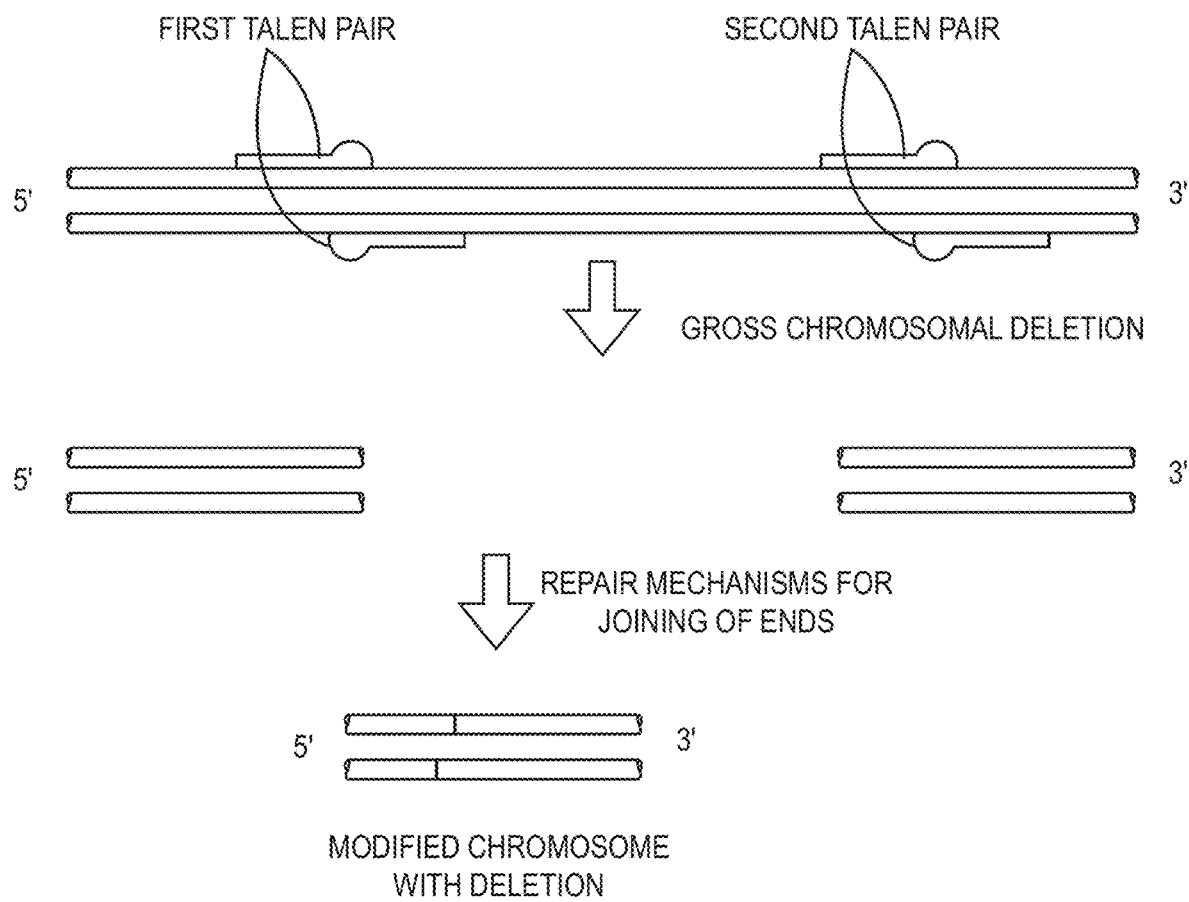
FIG. 2: An illustration of TALENs operating at a plurality of DNA loci.

Further, it was also discovered that TALENs could be used to make gross chromosomal deletions (GCDs) at a plurality of sites. FIG. 2 illustrates this approach, which involves a first TALEN pair directed to a first locus and a second TALEN pair directed to a second locus. It was also surprisingly discovered that inversions of large chromosomal sequences could be created using pairs of TALENs. One use of the inversions is the creation of artiodactyls or other founder animals with fixed genetic traits, or the creation of deletion strains.

Targeted endonuclease technologies, such as zinc finger nucleases (ZFNs), TAL effector nucleases (TALENs) and clustered regularly interspaced short palindromic repeats/ CRISPR associated endonuclease cas9 (CRISPR/Cas9) can be utilized to disrupt gene-function by introducing insertions and/or deletions (indels) into genomes of species, such as by non-homologous end-joining (NHEJ). However, indels introduced by NHEJ are variable in size and sequence which makes screening for functionally disrupted clones arduous and does not enable precise alterations. TALEN or CRISPR/ Cas9 mediated homology-directed repair (HDR) supports the introduction of defined nucleotide changes in lower eukaryotic models including yeast, zebrafish and, very recently, mice. These are models that allow for long-passage cells or primordial germ cells to be modified to make transgenic animals.

Demonstrated herein is precise, high frequency editing of a variety of genes in numerous working examples as exemplified in pig, goat, and cattle genomes. In some embodiments, the gene edits are indistinguishable from alleles that exist within a species or clade and represent the first demonstration of marker-free, non-meiotic allele introgression. High-efficiency and precise gene editing was achieved in certain commercially important loci in the genomes of livestock that are useful for agriculture, for research tools, or for biomedical purposes.

These processes have expanded the livestock gene-editing toolbox to include TALEN- and CRISPR/Cas9-stimulated homology-directed repair (HDR) using plasmid, rAAV, and oligonucleotide templates. Examples show that the *bovine* POLLED allele was introgressed into horned Holstein fibroblasts. This example demonstrates that various breeds of dairy cattle can be created that do not have horns. And this change can be made without disturbing other genes, or other parts of the genome, of the animals or cells. Single nucleotide alterations or small indels were introduced into other genes in pig, goat and cattle fibroblasts using TALEN mRNA and oligonucleotide transfection with efficiencies of 10-50% in populations. Several of the chosen edits mimicked naturally occurring performance enhancing or disease resistance alleles including, for the first time, alteration of single base pairs (bp). Up to 70% of fibroblasts colonies propagated without selection harbored the intended edits, of which over one half were homozygous. These efficiencies are sufficiently high that these changes can be made without reporters and/or without selection markers. These methods demonstrate meiosis-free intra- and inter-specific introgression of select alleles in livestock cells, large mammals, and livestock for research, agricultural and biomedical applications.

Sequences that are similar to, but differ somewhat from, the particular sequences described herein may be used, such as for generation of TALENs, guide RNAs, or homology-dependent repair templates. For instance, in some cases, sequences may be used that have at least 80% homology to the sequences described with particularly herein. The term "homology," as used herein, generally refers to calculations of "homology" or "percent homology" between two or more nucleotide or amino acid sequences that can be determined by aligning the sequences for optimal comparison purposes (e.g., gaps can be introduced in the sequence of a first sequence). The nucleotides at corresponding positions may then be compared, and the percent identity between the two sequences is a function of the number of identical positions shared by the sequences (i.e., % homology=# of identical positions/total # of positions×100). For example, if a position in the first sequence is occupied by the same nucleotide as the corresponding position in the second sequence, then the molecules are identical at that position. The percent homology between the two sequences is a function of the number of identical positions shared by the sequences, taking into account the number of gaps, and the length of each gap, which need to be introduced for optimal alignment of the two sequences. In some embodiments, the length of a sequence aligned for comparison purposes is at least about 80%, at least about 85%, at least about 90%, at least about 91%, at least about 92%, at least about 93%, at least about 94%, at least about 95%, at least about 96%, at least about 97%, at least about 98%, or at least about 99%, of the length of the reference sequence. In some cases, a sequence homology may be from about 70% to 100%. In some cases, a sequence homology may be from about 80% to 100%. In some cases, a sequence homology may be from about 90% to 100%. In some cases, a sequence homology may be from about 95% to 100%. In some cases, a sequence homology may be from about 80% to 99%. In some cases, a sequence homology may be from about 90% to 99%. In some cases, a sequence homology may be from about 95% to 99%. A BLAST® search may determine homology between two sequences. The two sequences can be genes, nucleotides sequences, protein sequences, peptide sequences, amino acid sequences, or fragments thereof.

Genetically Modified Animals

Animals may be modified using TALENs, zinc finger nucleases, or other genetic engineering tools, including various vectors that are known. A genetic modification made by such tools may comprise inactivation of a gene. The term inactivation of a gene refers to preventing the formation of a functional gene product. A gene product is functional only if it fulfills its normal (wild-type) functions. Materials and methods of genetically modifying animals are further detailed in U.S. Ser. No. 13/404,662 filed Feb. 24, 2012, Ser. No. 13/467,588 filed May 9, 2012, and Ser. No. 12/622,886 filed Nov. 10, 2009 which are hereby incorporated herein by reference for all purposes; in case of conflict, the instant specification is controlling. The term trans-acting refers to processes acting on a target gene from a different molecule (i.e., intermolecular). A trans-acting element is usually a DNA sequence that contains a gene. This gene codes for a protein (or microRNA or other diffusible molecule) that is used in the regulation of the target gene. The trans-acting gene may be on the same chromosome as the target gene, but the activity is via the intermediary protein or RNA that it encodes. Inactivation of a gene using a dominant negative generally involves a trans-acting element. The term cis-regulatory or cis-acting means an action without coding for protein or RNA; in the context of gene inactivation, this generally means inactivation of the coding portion of a gene, or a promoter and/or operator that is necessary for expression of the functional gene.

Various techniques known in the art can be used to introduce nucleic acid constructs into non-human animals to produce founder lines, in which the nucleic acid construct is integrated into the genome. Such techniques include, without limitation, pronuclear microinjection (U.S. Pat. No. 4,873,191), retrovirus mediated gene transfer into germ lines (Van der Putten et al. (1985) Proc. Natl. Acad. Sci. USA 82, 6148-1652), gene targeting into embryonic stem cells (Thompson et al. (1989) Cell 56, 313-321), electroporation of embryos (Lo (1983) Mol. Cell. Biol. 3, 1803-1814), sperm-mediated gene transfer (Lavitrano et al. (2002) Proc. Natl. Acad. Sci. USA 99, 14230-14235; Lavitrano et al. (2006) Reprod. Fert. Develop. 18, 19-23), and in vitro transformation of somatic cells, such as cumulus or mammary cells, or adult, fetal, or embryonic stem cells, followed by nuclear transplantation (Wilmut et al. (1997) Nature 385, 810-813; and Wakayama et al. (1998) Nature 394, 369-374). Pronuclear microinjection, sperm mediated gene transfer, and somatic cell nuclear transfer are particularly useful techniques, as well as cytoplasmic injection, primordial germ cell transplantation (Brinster), and blastocyst chimera production whereby a germ cell is propagated in an embryo.

Typically, in embryo/zygote pronuclear microinjection, a nucleic acid construct or mRNA is introduced into a fertilized egg; 1 or 2 cell fertilized eggs are used as the pronuclei containing the genetic material from the sperm head and the egg are visible within the protoplasm. Pronuclear staged fertilized eggs can be obtained in vitro or in vivo (i.e., surgically recovered from the oviduct of donor animals). In vitro fertilized eggs can be produced as follows. For example, swine ovaries can be collected at an abattoir, and maintained at 22-28° C. during transport. Ovaries can be washed and isolated for follicular aspiration, and follicles ranging from 4-8 mm can be aspirated into 50 mL conical centrifuge tubes using 18 gauge needles and under vacuum. Follicular fluid and aspirated oocytes can be rinsed through pre-filters with commercial TL-HEPES (Minitube, Verona, Wis.). Oocytes surrounded by a compact cumulus mass can be selected and placed into TCM-199 OOCYTE MATURATION MEDIUM (Minitube, Verona, Wis.) supplemented with 0.1 mg/mL cysteine, 10 ng/mL epidermal growth factor, 10% porcine follicular fluid, 50 µM 2-mercaptoethanol, 0.5 mg/ml cAMP, 10 IU/mL each of pregnant mare serum gonadotropin (PMSG) and human chorionic gonadotropin (hCG) for approximately 22 hours in humidified air at 38.7° C. and 5% CO2. Subsequently, the oocytes can be moved to fresh TCM-199 maturation medium, which will not contain cAMP, PMSG or hCG and incubated for an additional 22 hours. Matured oocytes can be stripped of their cumulus cells by vortexing in 0.1% hyaluronidase for 1 minute.

For swine, mature oocytes can be fertilized in 500 µl Minitube PORCPRO IVF MEDIUM SYSTEM (Minitube, Verona, Wis.) in Minitube 5-well fertilization dishes. In preparation for in vitro fertilization (IVF), freshly-collected or frozen boar semen can be washed and resuspended in PORCPRO IVF Medium to 4×105 sperm. Sperm concentrations can be analyzed by computer assisted semen analysis (SPERMVISION, Minitube, Verona, Wis.). Final in vitro insemination can be performed in a 10 µl volume at a final concentration of approximately 40 motile sperm/oocyte, depending on boar. Incubate all fertilizing oocytes at 38.7° C. in 5.0% $CO_2$ atmosphere for 6 hours. Six hours post-insemination, presumptive zygotes can be washed twice in NCSU-23 and moved to 0.5 mL of the same medium. This system can produce 20-30% blastocysts routinely across most boars with a 10-30% polyspermic insemination rate. Linearized nucleic acid constructs can be injected into one of the pronuclei, or e.g., transposons or cytoplasmic injection may be used. Then the injected eggs can be transferred to a recipient female (e.g., into the oviducts of a recipient female) and allowed to develop in the recipient female to produce the transgenic animals. In particular, in vitro fertilized embryos can be centrifuged at 15,000×g for 5 minutes to sediment lipids allowing visualization of the pronucleus. The embryos can be injected with using an Eppendorf FEMTOJET injector and can be cultured until blastocyst formation. Rates of embryo cleavage and blastocyst formation and quality can be recorded.

Embryos can be surgically transferred into uteri of asynchronous recipients. Typically, 100-200 (e.g., 150-200) embryos can be deposited into the ampulla-isthmus junction of the oviduct using a 5.5-inch TOMCAT® catheter. After surgery, real-time ultrasound examination of pregnancy can be performed.

In somatic cell nuclear transfer, a transgenic artiodactyl cell (e.g., a transgenic pig cell or *bovine* cell) such as an embryonic blastomere, fetal fibroblast, adult ear fibroblast, or granulosa cell that includes a nucleic acid construct described above, can be introduced into an enucleated oocyte to establish a combined cell. Oocytes can be enucleated by partial zona dissection near the polar body and then pressing out cytoplasm at the dissection area. Typically, an injection pipette with a sharp beveled tip is used to inject the transgenic cell into an enucleated oocyte arrested at meiosis 2. In some conventions, oocytes arrested at meiosis-2 are termed "eggs." After producing a porcine or *bovine* embryo (e.g., by fusing and activating the oocyte), the embryo is transferred to the oviducts of a recipient female, about 20 to 24 hours after activation. See, for example, Cibelli et al. (1998) Science 280, 1256-1258 and U.S. Pat. No. 6,548,741. For pigs, recipient females can be checked for pregnancy approximately 20-21 days after transfer of the embryos.

Standard breeding techniques can be used to create animals that are homozygous for the target nucleic acid from the initial heterozygous founder animals. Homozygosity may not be required in some instances, however. Transgenic pigs described herein can be bred with other pigs of interest.

In some embodiments, a nucleic acid of interest and a selectable marker can be provided on separate transposons and provided to either embryos or cells in unequal amount, where the amount of transposon containing the selectable marker far exceeds (5-10 fold excess) the transposon containing the nucleic acid of interest. Transgenic cells or animals expressing the nucleic acid of interest can be isolated based on presence and expression of the selectable marker. Because the transposons will integrate into the genome in a precise and unlinked way (independent transposition events), the nucleic acid of interest and the selectable marker are not genetically linked and can easily be separated by genetic segregation through standard breeding. Thus, transgenic animals can be produced that are not constrained to retain selectable markers in subsequent generations, an issue of some concern from a public safety perspective.

Once transgenic animal have been generated, expression of a target nucleic acid can be assessed using standard techniques. Initial screening can be accomplished by Southern blot analysis to determine whether or not integration of the construct has taken place. For a description of Southern analysis, see sections 9.37-9.52 of Sambrook et al., 1989,

*Molecular Cloning, A Laboratory Manual*, second edition, Cold Spring Harbor Press, Plainview; NY. Polymerase chain reaction (PCR) techniques also can be used in the initial screening. PCR refers to a procedure or technique in which target nucleic acids are amplified. Generally, sequence information from the ends of the region of interest or beyond is employed to design oligonucleotide primers that are identical or similar in sequence to opposite strands of the template to be amplified. PCR can be used to amplify specific sequences from DNA as well as RNA, including sequences from total genomic DNA or total cellular RNA. Primers typically are 14 to 40 nucleotides in length, but can range from 10 nucleotides to hundreds of nucleotides in length. PCR is described in, for example *PCR Primer: A Laboratory Manual*, ed. Dieffenbach and Dveksler, Cold Spring Harbor Laboratory Press, 1995. Nucleic acids also can be amplified by ligase chain reaction, strand displacement amplification, self-sustained sequence replication, or nucleic acid sequence-based amplified. See, for example, Lewis (1992) Genetic Engineering News 12:1; Guatelli et al. (1990) Proc. Natl. Acad. Sci. USA 87:1874; and Weiss (1991) Science 254:1292. At the blastocyst stage, embryos can be individually processed for analysis by, e.g., PCR, Southern hybridization and splinkerette PCR (see, e.g., Dupuy et al. Proc Natl Acad Sci USA (2002) 99:4495).

Expression of a nucleic acid sequence encoding a polypeptide in the tissues of transgenic pigs can be assessed using techniques that include, for example, Northern blot analysis of tissue samples obtained from the animal, in situ hybridization analysis, Western analysis, immunoassays such as enzyme-linked immunosorbent assays, and reverse-transcriptase PCR (RT-PCR).

Founder Animals, Animals Lines, Traits and Reproduction

Founder animals may be produced by cloning and other methods described herein. The founders can be homozygous for a genetic modification, as in the case where a zygote or a primary cell undergoes a homozygous modification. Similarly, founders can also be made that are heterozygous. The founders may be genomically modified, meaning that all of the cells in their genome have undergone modification. Founders can be mosaic for a modification, as may happen when vectors are introduced into one of a plurality of cells in an embryo, typically at a blastocyst stage. Progeny of mosaic animals may be tested to identify progeny that are genomically modified. An animal line is established when a pool of animals has been created that can be reproduced sexually or by assisted reproductive techniques, with heterogeneous or homozygous progeny consistently expressing the modification.

In livestock, many alleles are known to be linked to various traits such as production traits, type traits, workability traits, and other functional traits. Artisans are accustomed to monitoring and quantifying these traits, e.g., Visscher et al., *Livestock Production Science*, 40 (1994) 123-137, U.S. Pat. No. 7,709,206, US 2001/0016315, US 2011/0023140, and US 2005/0153317. An animal line may include a trait chosen from a trait in the group consisting of a production trait, a type trait, a workability trait, a fertility trait, a mothering trait, and a disease resistance trait. Further traits include expression of a recombinant gene product.

Animals with a desired trait or traits may be modified to prevent their sexual maturation. Since the animals are sterile until matured, it is possible to regulate sexual maturity as a means of controlling dissemination of the animals. Animals that have been bred or modified to have one or more traits can thus be provided to recipients with a reduced risk that the recipients will breed the animals and appropriate the value of the traits to themselves. Embodiments of the invention include genetically modifying a genome of an animal with the modification comprising an inactivated sexual maturation gene, wherein the sexual maturation gene in a wild type animal expresses a factor selective for sexual maturation. Embodiments include treating the animal by administering a compound to remedy a deficiency caused by the loss of expression of the gene to induce sexual maturation in the animal.

Breeding of animals that require administration of a compound to induce sexual maturity may advantageously be accomplished at a treatment facility. The treatment facility can implement standardized protocols on well-controlled stock to efficiently produce consistent animals. The animal progeny may be distributed to a plurality of locations to be raised. Farms and farmers (a term including a ranch and ranchers) may thus order a desired number of progeny with a specified range of ages and/or weights and/or traits and have them delivered at a desired time and/or location. The recipients, e.g., farmers, may then raise the animals and deliver them to market as they desire.

Embodiments include delivering (e.g., to one or more locations, to a plurality of farms) a genetically modified livestock animal having an inactivated neuroendocrine gene selective for sexual maturation. Embodiments include delivery of animals having an age of between about 1 day and about 180 days. The animal may have one or more traits (for example one that expresses a desired trait or a high-value trait or a novel trait or a recombinant trait). Embodiments further include providing said animal and/or breeding said animal.

Polypeptides

There are a variety of conservative changes that can generally be made to an amino acid sequence without altering activity. These changes are termed conservative substitutions or mutations; that is, an amino acid belonging to a grouping of amino acids having a particular size or characteristic can be substituted for another amino acid. Substitutes for an amino acid sequence may be selected from other members of the class to which the amino acid belongs. For example, the nonpolar (hydrophobic) amino acids include alanine, leucine, isoleucine, valine, proline, phenylalanine, tryptophan, and tyrosine. The polar neutral amino acids include glycine, serine, threonine, cysteine, tyrosine, asparagine and glutamine. The positively charged (basic) amino acids include arginine, lysine and histidine. The negatively charged (acidic) amino acids include aspartic acid and glutamic acid. Such alterations are not expected to substantially affect apparent molecular weight as determined by polyacrylamide gel electrophoresis or isoelectric point. Exemplary conservative substitutions include, but are not limited to, Lys for Arg and vice versa to maintain a positive charge; Glu for Asp and vice versa to maintain a negative charge; Ser for Thr so that a free——OH is maintained; and Gln for Asn to maintain a free $NH_2$. Moreover, point mutations, deletions, and insertions of the polypeptide sequences or corresponding nucleic acid sequences may in some cases be made without a loss of function of the polypeptide or nucleic acid fragment. Substitutions may include, e.g., 1, 2, 3, or more residues. The amino acid residues described herein employ either the single letter amino acid designator or the three-letter abbreviation. Abbreviations used herein are in keeping with the standard polypeptide nomenclature, J. Biol. Chem., (1969), 243, 3552-3559. All amino acid residue sequences are represented herein by formulae with left and right orientation in the conventional direction of amino-terminus to carboxy-terminus.

In some cases a determination of the percent identity of a peptide to a sequence set forth herein may be required. In such cases, the percent identity is measured in terms of the number of residues of the peptide, or a portion of the peptide. A polypeptide of, e.g., 90% identity, may also be a portion of a larger peptide. Embodiments include such polypeptides that have the indicated identity and/or conservative substitution of sequence set forth herein.

The term purified as used herein with reference to a polypeptide refers to a polypeptide that either has no naturally occurring counterpart (e.g., a peptidomimetic), or has been chemically synthesized and is thus substantially uncontaminated by other polypeptides, or has been separated or purified from other most cellular components by which it is naturally accompanied (e.g., other cellular proteins, polynucleotides, or cellular components). An example of a purified polypeptide is one that is at least 70%, by dry weight, free from the proteins and naturally occurring organic molecules with which it naturally associates. A preparation of a purified polypeptide therefore can be, for example, at least 80%, at least 90%, or at least 99%, by dry weight, the polypeptide. Polypeptides also can be engineered to contain a tag sequence (e.g., a polyhistidine tag, a myc tag, or a FLAG® tag) that facilitates the polypeptide to be purified or marked (e.g., captured onto an affinity matrix, visualized under a microscope). Thus a purified composition that comprises a polypeptide refers to a purified polypeptide unless otherwise indicated.

Polypeptides may include a chemical modification; a term that, in this context, refers to a change in the naturally-occurring chemical structure of amino acids. Such modifications may be made to a side chain or a terminus, e.g., changing the amino-terminus or carboxyl terminus. In some embodiments, the modifications are useful for creating chemical groups that may conveniently be used to link the polypeptides to other materials, or to attach a therapeutic agent.

Interfering RNAs

A variety of interfering RNA (RNAi) are known. Double-stranded RNA (dsRNA) induces sequence-specific degradation of homologous gene transcripts. RNA-induced silencing complex (RISC) metabolizes dsRNA to small 21-23-nucleotide small interfering RNAs (siRNAs). RISC contains a double stranded RNAse (dsRNase, e.g., Dicer) and ssRNase (e.g., Argonaut 2 or Ago2). RISC utilizes antisense strand as a guide to find a cleavable target. Both siRNAs and microRNAs (miRNAs) are known. A method of inactivating a gene in a genetically modified animal comprises inducing RNA interference against a target gene and/or nucleic acid such that expression of the target gene and/or nucleic acid is reduced.

For example the exogenous nucleic acid sequence can induce RNA interference against a nucleic acid encoding a polypeptide. For example, double-stranded small interfering RNA (siRNA) or small hairpin RNA (shRNA) homologous to a target DNA can be used to reduce expression of that DNA. Constructs for siRNA can be produced as described, for example, in Fire et al. (1998) Nature 391:806; Romano and Masino (1992) Mol. Microbiol. 6:3343; Cogoni et al. (1996) EMBO J. 15:3153; Cogoni and Masino (1999) Nature 399:166; Misquitta and Paterson (1999) Proc. Natl. Acad. Sci. USA 96:1451; and Kennerdell and Carthew (1998) Cell 95:1017. Constructs for shRNA can be produced as described by McIntyre and Fanning (2006) BMC Biotechnology 6:1. In general, shRNAs are transcribed as a single-stranded RNA molecule containing complementary regions, which can anneal and form short hairpins.

The probability of finding a single, individual functional siRNA or miRNA directed to a specific gene is high. The predictability of a specific sequence of siRNA, for instance, is about 50% but a number of interfering RNAs may be made with good confidence that at least one of them will be effective.

Embodiments include an in vitro cell, an in vivo cell, and a genetically modified animal such as a livestock animal that express an RNAi directed against a neuroendocrine gene selective for sexual maturation. An embodiment is an RNAi directed against a gene in the group consisting of Gpr54, Kiss1, and GnRH1. The RNAi may be, for instance, selected from the group consisting of siRNA, shRNA, dsRNA, RISC and miRNA.

Vectors and Nucleic Acids

A variety of nucleic acids may be introduced into the artiodactyl or other cells, for knockout purposes, or to obtain expression of a gene for other purposes. Nucleic acid constructs that can be used to produce transgenic animals include a target nucleic acid sequence. As used herein, the term nucleic acid includes DNA, RNA, and nucleic acid analogs, and nucleic acids that are double-stranded or single-stranded (i.e., a sense or an antisense single strand). Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-doxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six membered, morpholino ring, or peptide nucleic acids, in which the deoxyphosphate backbone is replaced by a pseudopeptide backbone and the four bases are retained. See, Summerton and Weller (1997) Antisense Nucleic Acid Drug Dev. 7(3):187; and Hyrup et al. (1996) Bioorgan. Med. Chem. 4:5. In addition, the deoxyphosphate backbone can be replaced with, for example, a phosphorothioate or phosphorodithioate backbone, a phosphoroamidite, or an alkyl phosphotriester backbone.

The target nucleic acid sequence can be operably linked to a regulatory region such as a promoter. Regulatory regions can be porcine regulatory regions or can be from other species. As used herein, operably linked refers to positioning of a regulatory region relative to a nucleic acid sequence in such a way as to permit or facilitate transcription of the target nucleic acid.

Any type of promoter can be operably linked to a target nucleic acid sequence. Examples of promoters include, without limitation, tissue-specific promoters, constitutive promoters, and promoters responsive or unresponsive to a particular stimulus. Suitable tissue specific promoters can result in preferential expression of a nucleic acid transcript in beta cells and include, for example, the human insulin promoter. Other tissue specific promoters can result in preferential expression in, for example, hepatocytes or heart tissue and can include the albumin or alpha-myosin heavy chain promoters, respectively. In other embodiments, a promoter that facilitates the expression of a nucleic acid molecule without significant tissue- or temporal-specificity can be used (i.e., a constitutive promoter). For example, a beta-actin promoter such as the chicken beta-actin gene promoter, ubiquitin promoter, miniCAGs promoter, glyceraldehyde-3-phosphate dehydrogenase (GAPDH) promoter, or 3-phosphoglycerate kinase (PGK) promoter can be used, as well as viral promoters such as the herpes simplex virus thymidine kinase (HSV-TK) promoter, the SV40 promoter, or a cytomegalovirus (CMV) promoter. In some embodiments, a fusion of the chicken beta actin gene promoter and the CMV enhancer is used as a promoter. See, for example, Xu et al. (2001) Hum. Gene Ther. 12:563; and Kiwaki et al. (1996) Hum. Gene Ther. 7:821.

An example of an inducible promoter is the tetracycline (tet)-on promoter system, which can be used to regulate transcription of the nucleic acid. In this system, a mutated Tet repressor (TetR) is fused to the activation domain of herpes simplex virus VP16 trans-activator protein to create a tetracycline-controlled transcriptional activator (tTA), which is regulated by tet or doxycycline (dox). In the absence of antibiotic, transcription is minimal, while in the presence of tet or dox, transcription is induced. Alternative inducible systems include the ecdysone or rapamycin systems. Ecdysone is an insect molting hormone whose production is controlled by a heterodimer of the ecdysone receptor and the product of the ultraspiracle gene (USP). Expression is induced by treatment with ecdysone or an analog of ecdysone such as muristerone A. The agent that is administered to the animal to trigger the inducible system is referred to as an induction agent.

Additional regulatory regions that may be useful in nucleic acid constructs, include, but are not limited to, polyadenylation sequences, translation control sequences (e.g., an internal ribosome entry segment, IRES), enhancers, inducible elements, or introns. Such regulatory regions may not be necessary, although they may increase expression by affecting transcription, stability of the mRNA, translational efficiency, or the like. Such regulatory regions can be included in a nucleic acid construct as desired to obtain optimal expression of the nucleic acids in the cell(s). Sufficient expression, however, can sometimes be obtained without such additional elements.

A nucleic acid construct may be used that encodes signal peptides or selectable markers. Signal peptides can be used such that an encoded polypeptide is directed to a particular cellular location (e.g., the cell surface). Non-limiting examples of selectable markers include puromycin, ganciclovir, adenosine deaminase (ADA), aminoglycoside phosphotransferase (neo, G418, APH), dihydrofolate reductase (DHFR), hygromycin-B-phosphtransferase, thymidine kinase (TK), and xanthin-guanine phosphoribosyltransferase (XGPRT). Such markers are useful for selecting stable transformants in culture. Other selectable markers include fluorescent polypeptides, such as green fluorescent protein or yellow fluorescent protein.

In some embodiments, a sequence encoding a selectable marker can be flanked by recognition sequences for a recombinase such as, e.g., Cre or Flp. For example, the selectable marker can be flanked by loxP recognition sites (34-bp recognition sites recognized by the Cre recombinase) or FRT recognition sites such that the selectable marker can be excised from the construct. See, Orban, et al., Proc. Natl. Acad. Sci. (1992) 89:6861, for a review of Cre/lox technology, and Brand and Dymecki, Dev. Cell (2004) 6:7. A transposon containing a Cre- or Flp-activatable transgene interrupted by a selectable marker gene also can be used to obtain transgenic animals with conditional expression of a transgene. For example, a promoter driving expression of the marker/transgene can be either ubiquitous or tissue-specific, which would result in the ubiquitous or tissue-specific expression of the marker in F0 animals (e.g., pigs). Tissue specific activation of the transgene can be accomplished, for example, by crossing a pig that ubiquitously expresses a marker-interrupted transgene to a pig expressing Cre or Flp in a tissue-specific manner, or by crossing a pig that expresses a marker-interrupted transgene in a tissue-specific manner to a pig that ubiquitously expresses Cre or Flp recombinase. Controlled expression of the transgene or controlled excision of the marker allows expression of the transgene.

In some embodiments, the target nucleic acid encodes a polypeptide. A nucleic acid sequence encoding a polypeptide can include a tag sequence that encodes a "tag" designed to facilitate subsequent manipulation of the encoded polypeptide (e.g., to facilitate localization or detection). Tag sequences can be inserted in the nucleic acid sequence encoding the polypeptide such that the encoded tag is located at either the carboxyl or amino terminus of the polypeptide. Non-limiting examples of encoded tags include glutathione S transferase (GST) and FLAG™ tag (Kodak, New Haven, Conn.).

In other embodiments, the target nucleic acid sequence induces RNA interference against a target nucleic acid such that expression of the target nucleic acid is reduced. For example the target nucleic acid sequence can induce RNA interference against a nucleic acid encoding a cystic fibrosis transmembrane conductance regulatory (CFTR) polypeptide. For example, double-stranded small interfering RNA (siRNA) or short hairpin RNA (shRNA) homologous to a CFTR DNA can be used to reduce expression of that DNA. Constructs for siRNA can be produced as described, for example, in Fire et al. (1998) Nature 391:806; Romano and Masino (1992) Mol. Microbiol. 6:3343; Cogoni et al. (1996) EMBO J. 15:3153; Cogoni and Masino (1999) Nature 399:166; Misquitta and Paterson (1999) Proc. Natl. Acad. Sci. USA 96:1451; and Kennerdell and Carthew (1998) Cell 95:1017. Constructs for shRNA can be produced as described by McIntyre and Fanning (2006) BMC Biotechnology 6:1. In general, shRNAs are transcribed as a single-stranded RNA molecule containing complementary regions, which can anneal and form short hairpins.

Nucleic acid constructs can be methylated using an SssI CpG methylase (New England Biolabs, Ipswich, Mass.). In general, the nucleic acid construct can be incubated with S-adenosylmethionine and SssI CpG-methylase in buffer at 37° C. Hypermethylation can be confirmed by incubating the construct with one unit of HinP1I endonuclease for 1 hour at 37° C. and assaying by agarose gel electrophoresis.

Nucleic acid constructs can be introduced into embryonic, fetal, or adult artiodactyl cells of any type, including, for example, germ cells such as an oocyte or an egg, a progenitor cell, an adult or embryonic stem cell, a primordial germ cell, a kidney cell such as a PK-15 cell, an islet cell, a beta cell, a liver cell, or a fibroblast such as a dermal fibroblast, using a variety of techniques. Non-limiting examples of techniques include the use of transposon systems, recombinant viruses that can infect cells, or liposomes or other non-viral methods such as electroporation, microinjection, or calcium phosphate precipitation, that are capable of delivering nucleic acids to cells.

In transposon systems, the transcriptional unit of a nucleic acid construct, i.e., the regulatory region operably linked to a target nucleic acid sequence, is flanked by an inverted repeat of a transposon. Several transposon systems, including, for example, Sleeping Beauty (see, U.S. Pat. No. 6,613,752 and U.S. Publication No. 2005/0003542); Frog Prince (Miskey et al. (2003) Nucleic Acids Res. 31:6873); Tol2 (Kawakami (2007) Genome Biology 8(Suppl.1):S7; Minos (Pavlopoulos et al. (2007) Genome Biology 8(Suppl.1):S2); Hsmar1 (Miskey et al. (2007)) Mol Cell Biol. 27:4589); and Passport have been developed to introduce nucleic acids into cells, including mice, human, and pig cells. The Sleeping Beauty and Passport transposon is particularly useful. A transposase can be delivered as a protein, encoded on the same nucleic acid construct as the target nucleic acid, can be introduced on a separate nucleic acid construct, or provided as an mRNA (e.g., an in vitro-transcribed and capped mRNA).

Insulator elements also can be included in a nucleic acid construct to maintain expression of the target nucleic acid and to inhibit the unwanted transcription of host genes. See, for example, U.S. Publication No. 2004/0203158. Typically, an insulator element flanks each side of the transcriptional unit and is internal to the inverted repeat of the transposon. Non-limiting examples of insulator elements include the matrix attachment region-(MAR) type insulator elements and border-type insulator elements. See, for example, U.S. Pat. Nos. 6,395,549, 5,731,178, 6,100,448 and 5,610,053, and U.S. Publication No. 2004/0203158.

Nucleic acids can be incorporated into vectors. A vector is a broad term that includes any specific DNA segment that is designed to move from a carrier into a target DNA. A vector may be referred to as an expression vector, or a vector system, which is a set of components needed to bring about DNA insertion into a genome or other targeted DNA sequence such as an episome, plasmid, or even virus/phage DNA segment. Vector systems such as viral vectors (e.g., retroviruses, adeno-associated virus and integrating phage viruses), and non-viral vectors (e.g., transposons) used for gene delivery in animals have two basic components: 1) a vector comprised of DNA (or RNA that is reverse transcribed into a cDNA) and 2) a transposase, recombinase, or other integrase enzyme that recognizes both the vector and a DNA target sequence and inserts the vector into the target DNA sequence. Vectors most often contain one or more expression cassettes that comprise one or more expression control sequences, wherein an expression control sequence is a DNA sequence that controls and regulates the transcription and/or translation of another DNA sequence or mRNA, respectively.

Many different types of vectors are known. For example, plasmids and viral vectors, e.g., retroviral vectors, are known. Mammalian expression plasmids typically have an origin of replication, a suitable promoter and optional enhancer, and also any necessary ribosome binding sites, a polyadenylation site, splice donor and acceptor sites, transcriptional termination sequences, and 5' flanking non-transcribed sequences. Examples of vectors include: plasmids (which may also be a carrier of another type of vector), adenovirus, adeno-associated virus (AAV), lentivirus (e.g., HIV-1, SIV or FIV), retrovirus (e.g., ASV, ALV or MoMLV), and transposons (e.g., Sleeping Beauty, P-elements, Tol-2, Frog Prince, piggyBac).

As used herein, the term nucleic acid refers to both RNA and DNA, including, for example, cDNA, genomic DNA, synthetic (e.g., chemically synthesized) DNA, as well as naturally occurring and chemically modified nucleic acids, e.g., synthetic bases or alternative backbones. A nucleic acid molecule can be double-stranded or single-stranded (i.e., a sense or an antisense single strand). The term transgenic is used broadly herein and refers to a genetically modified organism or genetically engineered organism whose genetic material has been altered using genetic engineering techniques. A knockout artiodactyl is thus transgenic regardless of whether or not exogenous genes or nucleic acids are expressed in the animal or its progeny.

The nucleic acid sequences set forth herein are intended to represent both DNA and RNA sequences, according to the conventional practice of allowing the abbreviation "T" stand for "T" or for "U", as the case may be, for DNA or RNA. Polynucleotides are nucleic acid molecules of at least three nucleotide subunits. Polynucleotide analogues or polynucleic acids are chemically modified polynucleotides or polynucleic acids. In some embodiments, polynucleotide analogues can be generated by replacing portions of the sugar-phosphate backbone of a polynucleotide with alternative functional groups. Morpholino-modified polynucleotides, referred to herein as "morpholinos," are polynucleotide analogues in which the bases are linked by a morpholino-phosphorodiamidate backbone (see, e.g., U.S. Pat. Nos. 5,142,047 and 5,185,444). In addition to morpholinos, other examples of polynucleotide analogues include analogues in which the bases are linked by a polyvinyl backbone, peptide nucleic acids (PNAs) in which the bases are linked by amide bonds formed by pseudopeptide 2-aminoethyl-glycine groups, analogues in which the nucleoside subunits are linked by methylphosphonate groups, analogues in which the phosphate residues linking nucleoside subunits are replaced by phosphoroamidate groups, and phosphorothioated DNAs, analogues containing sugar moieties that have 2' O-methyl group). Polynucleotides of the invention can be produced through the well-known and routinely used technique of solid phase synthesis. Alternatively, other suitable methods for such synthesis can be used (e.g., common molecular cloning and chemical nucleic acid synthesis techniques). Similar techniques also can be used to prepare polynucleotide analogues such as morpholinos or phosphorothioate derivatives. In addition, polynucleotides and polynucleotide analogues can be obtained commercially. For oligonucleotides, examples of pharmaceutically acceptable compositions are salts that include, e.g., (a) salts formed with cations such as sodium, potassium, ammonium, etc.; (b) acid addition salts formed with inorganic acids, for example, hydrochloric acid, hydrobromic acid (c) salts formed with organic acids e.g., for example, acetic acid, oxalic acid, tartaric acid; and (d) salts formed from elemental anions e.g., chlorine, bromine, and iodine.

A sequence alignment is a way of arranging the sequences of DNA, RNA, or protein to identify regions of similarity. Aligned sequences of nucleotide or amino acid residues are typically represented as rows within a matrix, with gaps are inserted between the residues so that identical or similar characters are aligned in successive columns.

Dominant Negatives

Genes may thus be inactivated not only by removal or RNAi suppression but also by creation of a dominant negative phenotype. A dominant negative version of a gene product lacks one or more functions of the wild-type phenotype and dominantly interferes with the function of a normal gene product expressed in the same cell, with a result that the dominant negative phenotype effectively decreases or inactivates the physiological outcome normally expected to be elicited by a gene's normal function. For example, the function of most proteins requires their interaction with other proteins. Such interactions are often required for proper protein localization, ligand binding, protein activation, or the downstream transduction of upstream signals. The mutation of one or more of the components of a multi-protein complex can interfere with one these processes. Thus, the expression of a mutant form of a protein can interfere with a proteins function, even in the presence of a normal gene product, acting as a poison "pill" or a "monkey wrench" into the gearbox. GPCRs are seven-transmembrane (7TM) domain receptors which are trafficked through the biosynthetic pathway to the cell surface in a tightly regulated mechanism with multiple steps and a stringent quality control system to ensure correct GPCR folding and targeting. Association of GPCRs with accessory proteins or chaperones are a key step for the forward trafficking through the endoplasmic reticulum (ER) and Golgi. The life of GPCRs begins in the ER where they are synthesized, folded and assembled. During their migration to the cell surface, GPCRs undergo post-translational modifications to attain mature status. Because the ER forms part of the cellular quality control machinery where functionally inactive mutant GPCRs can be prevented from expression at the cell surface.

Conditions such as X-linked nephrogenic-diabetes insipidus, familial hypocalciuric hypercalcemia, familial glucocorticoid deficiency or hypogonadodotropic hypogonadism are associated with mutations in GPCRs which result in intracellular retention in the ER or Golgi compartments. In numerous cases the defect in cell surface membrane expression is due to intracellular association of receptors, with a dominant-negative (DN) effect of the misfolded receptor on its wild-type counterpart; this DN effect may limit, or even abrogate, plasma membrane expression of the normal receptor and thus provoke a loss-of-function disease (Ulloa-Aguirre et al., 2004a).

Loss-of-function mutations in the GnRHR can lead to partial or complete hypogonadotropic hypogonadism (HH), a failure of pituitary gonadotropes to respond to GnRH, which results in decreased or apulsatile gonadotropin release and reproductive failure. A large number of mutations leading to receptor misfolding and resultant misrouting of the gonadotropin hormone-releasing hormone receptor (GnRHR) in patients with HH have been described (Janovick et al., 2002; Leaños-Miranda et al., 2002; Ulloa-Aguirre et al., 2004b). Many of these mutations act as Dominant negatives for GnRHR function (Pask A J et al, 2005 Mol Endocrinol; Brothers S P et al, 2004 Mol Endocrinol; Leaños-Miranda A et al, 2003 J Clin Endocrinol Metab). Thus, purposeful expression of a DN GnRHR gene is expected to cause sterility in transgenic animals.

As discussed, GPR54 is a gatekeeper of the reproductive cascade that initiates puberty. Animal studies demonstrate that engagement of GPR54 by endogenous peptide ligands, termed kisspeptins, potently stimulates gonadotropin-releasing hormone release from hypothalamic neurons to activate the hypothalamic-pituitary-gonadal axis. Furthermore, the characterization of GPR54 KO mice, which phenocopy the human condition of idiopathic hypogonadotropic hypogonadism, confirmed the essential role of GPR54 for reproductive function. GPCRs are now recognized to exist as multiprotein complexes composed of GPCR-interacting proteins (GIPs) that impart precise spatial and temporal regulation of expression, trafficking, ligand binding, and signaling. GPR54 has been determined to specifically interact with these GIPs. Because the majority of truncated GPCR splice variants act as dominant-negative mutations (Wise 2012, J Mol Signal), the expression of GPR54 lacking one or more transmembrane domains is expected to disrupt the processing/trafficking of endogenous GPR54, thus interfering with its function. Thus, purposeful expression of a DN GPR54 gene is expected to cause sterility in transgenic animals.

Templated and Non-Templated Repairs

TALENs, zinc finger nucleases, CRISPR nuclease (e.g., CRISPR/Cas9) and recombinase fusion proteins may be used with or without a template. A template is an exogenous DNA added to the cell for cellular repair machinery to use as a guide (template) to repair double stranded breaks (DSB) in DNA. This process is generally referred to as homology directed repair (HDR). Processes without a template involve making DSBs and providing for cellular machinery to make repairs that are often less than perfect, so that an insertion or deletion (an indel) is made. The cellular pathway referred to as non-homologous end joining (NHEJ) typically mediates non-templated repairs of DSBs. The term NHEJ is commonly used to refer to all such non-templated repairs regardless of whether the NHEJ was involved, or an alternative cellular pathway.

Extended Hypothermia for Template-Directed Repair

Experiments surprisingly showed that an extended period of hypothermic culture could enhance the efficiency of templating processes. Hypothermic cell cultures are known to be useful for up to about three days to introduce double-stranded DNA breaks. Conventional theories for this effect revolve around the idea that the active enzymes are being diluted or the DNA is stabilized by inhibiting division.

The data herein, however, are not consistent with these other theories. Instead, it is believed that hypothermia minimizes re-repair of altered chromosomes as guided by the sister chromatid. In other words, even if there is successful integration, the cell may use the sister chromatid at the altered site to undo the changed allele. Moreover, these data are the first to show that hypothermia could be used to impact templating processes. A surprising aspect of the experiments was that the extended hypothermic culture did not improve the efficiency of copying the template into the cellular DNA. What it improved was the stability of the exogenous allele after it had been copied. In fact, this process almost tripled the level of SNP HDR-edited alleles.

An embodiment is a hypothermic method of template-directed repair to change a chromosomal DNA of a cell, comprising introducing into a living cell a targeted nuclease system and a nucleic acid template, wherein the targeted nuclease system and the template operate to alter the chromosomal DNA to have identity to the template sequence wherein the living cell is maintained at a hypothermic culturing temperature below a physiological temperature for a time period. The length of the culture can be varied as appropriate, e.g., more than 3 days to 31 days or 72 to 800 hours; artisans will immediately appreciate that all ranges and values within the explicitly stated range are contemplated; e.g., 72 to 80 hours, 80 to 600 hours, 3 days to 5 days, 4 days to 15 days, 3.1 days to two weeks, and so forth. Extended culture times at about 20° C. have been successful (data not shown). The hypothermic culture temperature ranges from 20 to 34° C.; artisans will immediately appreciate that all ranges and values within the explicitly stated range are contemplated; e.g., 20 to 25° C., 21 to 26° C., 22 to 27° C., 23 to 28° C., 24 to 29° C., 21 to 30° C. Moreover embodiments include maintaining the culture at a specific temperature within the range as well as allowing the culture temperature to change while remaining within the range. The term "kept within a range" in this context includes both these embodiments. Embodiments include culturing to provide a stability of an allele introduced into a cell; for example, a modified allele may remain stable (i.e., continue to be present in the population) for more than 5 cell divisions, or at least 3 cell divisions, or a value between 3 and 10 cell divisions; artisans will immediately appreciate that all ranges and values within the explicitly stated range are contemplated.

SNPs

These experimental results provide a process for placing single nucleotide polymorphisms (SNPs) into chromosomal DNA. The SNPs can be placed at a predetermined position. This control over placement is without precedent. For instance an SNP can be placed into an endogenous allele without other SNPs or modifications at other locations. Moreover, and crucially, an endogenous allele can be replaced with an exogenous allele that differs by only one SNP. An endogenous allele can be edited to another allele by the creation of an SNP within the allele. And the replacements are made with minimal alterations to chromosomal DNA at any location in genome of the cell. One or more SNPs may be introgressed.

An embodiment is a method of creating a single nucleotide polymorphism (SNP) in a chromosomal DNA of a cell, comprising introducing a targeted nuclease system and a HDR template into the cell, with the targeted nuclease system comprising a DNA-binding member for specifically binding an endogenous cognate sequence in the chromosomal DNA, wherein the targeted nuclease system and the HDR template operate to alter the chromosomal DNA to have identity to the HDR template sequence, wherein the HDR template sequence comprises a SNP. The HDR template may have a plurality of SNPs or only one. Other changes may be present, e.g., insertions, deletions, or substitutions. Or the changes may be limited to a single SNP, or one or a plurality of SNPs introgressed into the endogenous allele. The HDR template sequence may comprise an exogenous allele that replaces an endogenous allele, with the exogenous allele comprising an SNP in a sequence alignment with the endogenous allele.

Further embodiments include placing an SNP into a cognate site for a DNA-binding member of a targeted nuclease system. The SNP may be chosen to reduce binding to the DNA-binding member. One SNP may be thusly placed, or a plurality. Further changes, SNPs, or others, may be present in the allele, or not. The chromosomal DNA may be free of all other changes.

Embodiments include a genetically modified animal, the animal belonging to a breed of animals having an endogenous allele, the animal comprising a genetic change at an SNP to change the chromosomal DNA of the animal from the endogenous allele to an exogenous allele found in another species or another breed of animal. The animal may comprise one or more of: a plurality of SNPs to change the chromosomal DNA of the animal from the endogenous allele to an exogenous allele found in another species or another breed of animal; further being free or reporters; being homozygous for the polymorphism, SNP or SNPs; being a livestock, primate, swine, cow, horse, sheep, goat, avian, chicken, rabbit, fish, dog, mouse, cat, rat, and laboratory animal.

These various embodiments can be performed in a reporter-free system and to make an SNP or an embodiment relating to an SNP. The cells or animals may be, e.g., livestock, primate, swine, cow, horse, sheep, goat, avian, chicken, rabbit, fish, dog, mouse, cat, rat, and laboratory animal.

Targeted Nuclease Systems

Genome editing tools such as transcription activator-like effector nucleases (TALENs) and zinc finger nucleases (ZFNs) have impacted the fields of biotechnology, gene therapy and functional genomic studies in many organisms. More recently, RNA-guided endonucleases (RGENs) are directed to their target sites by a complementary RNA molecule. The Cas9/CRISPR system is a RGEN. tracrRNA is another such tool. These are examples of targeted nuclease systems: these system have a DNA-binding member that localizes the nuclease to a target site. The site is then cut by the nuclease. TALENs and ZFNs have the nuclease fused to the DNA-binding member. Cas9/CRISPR are cognates that find each other on the target DNA. The DNA-binding member has a cognate sequence in the chromosomal DNA. The DNA-binding member is typically designed in light of the intended cognate sequence so as to obtain a nucleolytic action at nor near an intended site. Certain embodiments are applicable to all such systems without limitation; including, embodiments that minimize nuclease re-cleavage, embodiments for making SNPs with precision at an intended residue, embodiments for making indels with precision at an intended residue and placement of the allele that is being introgressed at the DNA-binding site.

Gene Editing to Avoid Re-Binding by Nuclease Systems

Experimental results suggested that targeted (endo)nuclease systems were effectively cutting dsDNA at the intended cognate sites. Analysis of the data suggested that the nucleases would bind to sites that had already been templated and re-cleave the site, causing a reversion of the dsDNA to its original sequence. Targeted nuclease systems include a motif that binds to the cognate DNA, either by protein-to-DNA binding, or by nucleic acid-to-DNA binding. Experiments demonstrated that templates that contain polymorphisms can be selected to confound the re-binding or re-cutting by the targeted nuclease, thereby increasing significantly the number of precisely introgressed cellular clones.

Embodiments for reducing re-binding include a method of homology-directed repair (HDR) to introgress an exogenous allele into chromosomal DNA of a cell, comprising introducing a targeted nuclease system and a HDR template that comprises the exogenous allele into the cell, with the targeted nuclease system comprising a DNA-binding member for specifically binding an endogenous cognate sequence in the chromosomal DNA, wherein the targeted nuclease system and the HDR template operate to alter the chromosomal DNA to have identity to the HDR template sequence and to introgress the exogenous allele into the chromosomal DNA in place of an endogenous allele. In one embodiment the HDR template sequence is designed to reduce specific binding of the DNA-binding member to the HDR template sequence. In one embodiment the HDR template sequence is designed to introduce a polymorphism intended to reduce the specific binding of the DNA-binding member to genomic sequence once introgressed. Alternatively, the DNA-binding member of the targeted nuclease can be designed to recognize nucleotide sequences that aren't present in endogenous or exogenous sequence. Whereas the level of this hobbled DNA-binding member is sufficient to enable cleavage of the endogenous allele, the intended polymorphisms from the HDR template further alter the target site and decreases re-cleavage of precisely introgressed alleles. This results in a higher frequency of cellular clones within a population that contain those precise introgression events.

The term allele means one of two or more forms of a gene. A population or species of organisms typically includes multiple alleles at each locus among various individuals. Allelic variation at a locus is measurable as the number of alleles (polymorphisms) present, or the proportion of heterozygotes in the population. The term natural allele as used herein means an allele found in nature in the same species of organism that is being modified. The term novel allele means a non-natural allele. A human allele placed into a goat is a novel allele. The term synthetic allele means an allele that has not yet been found in nature. An exogenous allele is one that is introduced into an organism, and the endogenous allele is the one that is already in the cell, usually the one that is in the organism in its wild-type unmodified state. Animals that are heterozygous have two alleles. In some cases, it is desirable to introduce an exogenous allele to make an animal homozygous for an allele that is already present in the heterozygous animal. Movement of an allele interspecies means from one species of animal to another and intraspecies means movement between animals of the same species. The term exogenous allele is broad and includes DNA with, e.g., native, novel or synthetic SNPs or indels, reporters, endonuclease digestion sites, promoters, and vectors.

Homology directed repair (HDR) is a mechanism in cells to repair ssDNA and double stranded DNA (dsDNA) lesions. This repair mechanism can be used by the cell when there is an HDR template present that has a sequence with significant homology to the lesion site. Specific binding, as that term is commonly used in the biological arts, refers to a molecule that binds to a target with a relatively high affinity compared to non-target sequences, and generally involves a plurality of non-covalent interactions, such as electrostatic interactions, van der Waals interactions, hydrogen bonding, and the like. Specific binding involves processes of binding to a substrate and releasing from a substrate; as such it can be affected by changes in the efficiency of binding and release from a substrate as well as by a strength of the binding to the substrate. Accordingly, a reduction in specific binding may result from a lesser affinity to a substrate that reduces the number of binding events, or it may result from a reduced strength of binding to the substrate that reduces how long the binding is maintained. In the context of targeted endonucleases, without being bound to a particular theory, a change in specific binding of the endonuclease or guide sequence to the DNA can affect not only that actual binding but also be involved in an incompletely understood process of forming complexes with targeted and/or template DNA or RNA. Therefore specific binding can be measured relative to the actual DNA-binding events and is a useful feature for manipulating those processes, even if the actual events at the chromosomal level involve more or less than actual DNA-binding. Specific hybridization is a form of specific binding between nucleic acids that have complementary sequences. Proteins can also specifically bind to DNA, for instance, in TALENs or CRISPR/Cas9 systems or by Gal4 motifs. Introgression of an allele refers to a process of copying an exogenous allele over an endogenous allele with a template-guided process. The endogenous allele might actually be excised and replaced by an exogenous nucleic acid allele in some situations but present theory is that the process is a copying mechanism. Since alleles are gene pairs, there is significant homology between them. The allele might be a gene that encodes a protein, or it could have other functions such as encoding a bioactive RNA chain or providing a site for receiving a regulatory protein or RNA.

The HDR template is a nucleic acid that comprises a sequence that, when inserted into the target genome, results in an altered allele. The template may be a dsDNA or a single-stranded DNA (ssDNA). ssDNA templates are preferably from about 20 to about 5000 residues although other lengths can be used. Artisans will immediately appreciate that all ranges and values within the explicitly stated range are contemplated; e.g., from 500 to 1500 residues, from 20 to 100 residues, and so forth. The template may further comprise flanking sequences that provide homology to DNA adjacent to the endogenous allele. The template may also comprise a sequence that is bound to a targeted nuclease system, and is thus the cognate binding site for the system's DNA-binding member. The term cognate refers to two biomolecules that typically interact, for example, a receptor and its ligand. In the context of HDR processes, one of the biomolecules may be designed with a sequence to bind with an intended, i.e., cognate, DNA site or protein site.

One embodiment for reducing specific binding to a targeted nuclease system comprises making changes in the HDR template relative to its alignment with the endogenous DNA. One type of change is designed to create mismatches between the cognate members. One change is an insertion or a deletion of one or more residues. Another change is a substitution of one residue for another residue that does not promote binding. The term residue refers to a unit in a molecular chain, e.g., an amino acid in a protein or a base in a nucleic acid. One place to make the change is at the cognate binding site for the system's DNA-binding member. Another type of change is designed to interfere with operation of the nucleases by making the change is in the spacer in systems that operate with a spacer, e.g., TALENs pairs, the change may be made in the spacer area. These changes may include a deletion, e.g., so that the nucleases are hindered from making cuts. These various changes are generally referred to as mismatches herein since they create mismatches when the sequences are aligned; in this context, a deletion, insertion, or substitution is a mismatch. Artisans routinely make alignments of sequences so that mismatches are readily identified with specificity. Pairs of nucleases require a spacing that provides a cooperativity; their activity can be disrupted by additions or subtractions to the spacer.

Further embodiments place a mismatch in the exogenous allele. The system's DNA-binding member is designed to bind at a site that at least partially overlaps with the endogenous allele. Once it is introgressed to have identity with the exogenous allele, the DNA-binding member has reduced binding. The DNA-binding member's cognate site thus changes from a preferred endogenous allele to a not-preferred exogenous allele. The cognate site may encompass all of the allele, or just a part of it. It is surprising that the introduction of a mismatch into the exogenous allele is required to stabilize the introgression of the exogenous allele. Apparently the problem of re-cleavage has a very large impact on stability of introgressed alleles. The data that shows this impact was not previously obtained by others because processes with a comparable efficiency were not conventionally available.

Embodiments include creating, with an HDR templating process, mismatches at these various places by insertion, deletion, or substitution of a residue. For instance, from 1-60 residues may be inserted, deleted, or substituted; artisans will immediately appreciate that all ranges and values within the explicitly stated range are contemplated; e.g., 1-3 residues, at least 10 residues, 4 residues, 4-20 residues, and so forth. One or more of these may be combined, e.g., an insertion at one place, a deletion at another, and a substitution at other places.

Embodiments include designing the DNA-binding member of the targeting endonuclease to place a mismatch in the DNA-binding member sequence as aligned with the endogenous chromosomal DNA. The mismatch would typically also be a mismatch for the exogenous DNA. These mismatches reduce targeted nuclease rebinding. Further mismatches may be used in combination with this method as already described, e.g., with the DNA-binding sites of the endonucleases chosen at positions wherein introgression of the exogenous allele; the HDR template having mismatches at the DNA-binding cognates; or in the spacer region to change the spacing.

These various embodiments can be performed in a reporter-free system and to make an SNP or an embodiment relating to an SNP. The cells or animals may be, e.g., vertebrate, livestock, primate, swine, cow, horse, sheep, goat, chicken, rabbit, fish, dog, mouse, cat, rat, and laboratory animal.

Zinc Finger Nucleases

Zinc-finger nucleases (ZFNs) are artificial restriction enzymes generated by fusing a zinc finger DNA-binding domain to a DNA-cleavage domain. Zinc finger domains can be engineered to target desired DNA sequences and this enables zinc-finger nucleases to target unique sequences within complex genomes. By taking advantage of endogenous DNA repair machinery, these reagents can be used to alter the genomes of higher organisms. ZFNs may be used in methods for inactivating genes.

A zinc finger DNA-binding domain has about 30 amino acids and folds into a stable structure. Each finger primarily binds to a triplet within the DNA substrate. Amino acid residues at key positions contribute to most of the sequence-specific interactions with the DNA site. These amino acids can be changed while maintaining the remaining amino acids to preserve the necessary structure. Binding to longer DNA sequences is achieved by linking several domains in tandem. Other functionalities like non-specific FokI cleavage domain (N), transcription activator domains (A), transcription repressor domains (R) and methylases (M) can be fused to a ZFPs to form ZFNs respectively, zinc finger transcription activators (ZFA), zinc finger transcription repressors (ZFR, and zinc finger methylases (ZFM). Materials and methods for using zinc fingers and zinc finger nucleases for making genetically modified animals are disclosed in, e.g., U.S. Pat. No. 8,106,255 US20120192298, US20110023159, and US20110281306.

TALENs

The term TALEN, as used herein, is broad and includes a monomeric TALEN that can cleave double stranded DNA without assistance from another TALEN, e.g., as in Beurdeley, M. et al. Compact designer TALENs for efficient genome engineering. Nat. Commun. 4:1762 doi: 10.1038/ncomms2782 (2013). The term TALEN is also used to refer to one or both members of a pair of TALENs that are engineered to work together to cleave DNA at the same site. TALENs that work together may be referred to as a left-TALEN and a right-TALEN, which references the handedness of DNA or a TALEN-pair.

One of the challenges to making TALEN-modified livestock or other animals is that the efficiency of making a modification to an animal cell is only a few percent with conventional best practices. Achievement of a deletion or an insertion at an intended site does not necessarily mean success because it may not actually create the intended effect, such as expressing an exogenous protein or stopping expression of an endogenous protein. Even a low efficiency can be useful for the creation of genetically modified lower animals such as fruit flies or mice because they have short and prolific reproductive cycles that provide for the creating, testing, and screening of hundreds of animals to determine if there are a few that have been successfully modified. These levels of efficiency that are conventionally achieved, however, are not suited to livestock artiodactyls that have much longer gestational times and comparatively few progeny per pregnancy. U.S. Ser. No. 13/404,662 filed Feb. 24, 2012 "Genetically modified animals and methods for making the same", which is hereby incorporated herein by reference for all purposes (in case of conflict, the specification is controlling) provides certain methods that address these conventional limitations.

Another barrier to using TALENs to modify livestock is that TALEN-mediated modification of DNA in primary cells is difficult because the cells are unstable. U.S. Pub. No. 2011/0197290 filed Feb. 11, 2011 provides useful methods for modifying these cells, and is hereby incorporated herein by reference for all purposes; in case of conflict, the specification is controlling. Indeed, it is shown herein that frequency of TALEN-modified cells decreases significantly over time in the absence of enrichment or selection methods. Without being bound to a particular theory, it is theorized that DNA cleavage at non-intended sites can compromise the stability of the cell by inducing apoptosis or disabling non-target genes.

The term primary cell means a cell isolated from a living animal, wherein the cell has undergone between 0 and 2, 0 and 3, 0 and 4, 0 and 5, 0 and 6, 0 and 7, 0 and 8, 0 and 9, or 0 and 10 replications since its isolation from the tissue. TALENs may be used to make genetically modified artiodactyl primary cells. These modifications are suited to making founders of genetically modified animal lines by cloning. Also described herein are direct-embryonic injections that that may be used to modify zygotes or embryos, with the modified zygotes or embryos being suited to implant into surrogate females for gestation and delivery of founder animal lines.

As a result, techniques customarily used to create and test transformed cells for successful genetic modification can not be used in primary cells due to their propensity to senesce. TALEN-modified cells are customarily destroyed to assay their genetic modification, or isolated to grow clonal lines with many identical cells from one parent. However, primary cells are inherently unstable and typically undergo genetic changes, senescence, and/or cell death when attempts are made to genetically modify and clonally expand them. TALEN-modified cells are even less stable, as documented herein for the first time. As a result, it is unreasonable to expect high rates of success when using conventional approaches that involve modifying a primary cell for somatic cell nuclear transfer or other animal cloning technique. As reported herein, however, TALENs have been used to make genetically modified artiodactyl primary cells. These modifications are suited to making founders of genetically modified animal lines by cloning or direct-embryonic injections. Also described herein are direct-embryonic injections that were used to modify zygotes, with the modified zygotes being suited to implant into surrogate females for gestation and delivery of founder animal lines.

A typical approach to testing for an actual TALEN-mediated insertion/deletion event is to sequence the modified cell or zygote, which is a destructive process. Thus when a zygote or embryo is modified before implantation to a surrogate, its modification cannot be verified with any degree of convenience until the animal is born. It is not conventionally appreciated that an actual production process for making genetically modified animals by cloning will benefit from a process for testing for the presence of a genetic modification. There are inventions presented herein that provide for an indication of genetic modification at the single cell, zygote, or oocyte stage. As shown herein, expression of a reporter gene that is not coupled to TALEN modification is, despite not being part of the reporter gene expression cassette, nonetheless generally predictive of a desired genetic modification. More specifically, the expression of the reporter gene indicates that the nucleic acids were effectively delivered and being expressed in a cell or embryo; a reporter-expressing cell or embryo is more likely to have undergone TALEN-based modification.

Another technique for making modified organisms was the use of a co-transfection, co-selection technique. The cells that express the reporter are selected for, and may be used for making genetically modified animals. The reporter may be chosen to require transposase activity. Without being bound to a specific theory, it is theorized that cells that have undergone transposition have 1) been transfected and 2) been competent for double stranded DNA repair, thus increasing the likelihood of TALEN-based modification in selected clones. This also facilitates enrichment/selection for transposed cells (and by extension TALEN-modified cells). The fact that the transposon is operably but not physically linked to the TALEN modification permits their segregation away from each other by breeding. A benefit of a co-transfection strategy is that the reporter, or reporters, may be placed on a chromosome that is not the same chromosome that is modified by TALENs. This process provides for the creation of founder animals that have no reporter genes. For example, some animals were made by using plasmids carrying reporter genes that were independent of the genetic modification, which was orchestrated separately in the cells. This scheme was based on a theory of operation that cells that incorporate new reporter genes will also incorporate genetic modifications. For instance, data provided herein shows that cells can be transfected with four independent plasmids and the successful incorporation of the gene product of one plasmid is predictive of successful incorporation of the other plasmid gene products and also for the success of TALEN-mediated changes. Conventional wisdom is that transfection with so many plasmids would not be successful and would yield unhealthy cells. Unexpectedly, however, these techniques were effective.

Miller et al. (Miller et al. (2011) Nature Biotechnol 29:143) reported making TALENs for site-specific nuclease architecture by linking TAL truncation variants to the catalytic domain of FokI nuclease. The resulting TALENs were shown to induce gene modification in immortalized human cells by means of the two major eukaryotic DNA repair pathways, non-homologous end joining (NHEJ) and homology directed repair. The TALENs can be engineered for specific binding. Specific binding, as that term is commonly used in the biological arts, refers to a molecule that binds to a target with a relatively high affinity compared to non-target tissues, and generally involves a plurality of non-covalent interactions, such as electrostatic interactions, van der Waals interactions, hydrogen bonding, and the like. Specific binding interactions characterize antibody-antigen binding, enzyme-substrate binding, and specifically binding protein-receptor interactions.

The cipher for TALs has been reported (PCT Application WO 2011/072246) wherein each DNA binding repeat is responsible for recognizing one base pair in the target DNA sequence. The residues may be assembled to target a DNA sequence, with: (a) HD for recognition of C/G; (b) NI for recognition of A/T; (c) NG for recognition of T/A; (d) NS for recognition of C/G or A/T or T/A or G/C; (e) NN for recognition of G/C or A/T; (f) IG for recognition of T/A; (g) N for recognition of C/G; (h) HG for recognition of C/G or T/A; (i) H for recognition of T/A; and (j) NK for recognition of G/C. In brief, a target site for binding of a TALEN is determined and a fusion molecule comprising a nuclease and a series of RVDs that recognize the target site is created. Upon binding, the nuclease cleaves the DNA so that cellular repair machinery can operate to make a genetic modification at the cut ends. The term TALEN means a protein comprising a Transcription Activator-like (TAL) effector binding domain and a nuclease domain and includes monomeric TALENs that are functional per se as well as others that require dimerization with another monomeric TALEN. The dimerization can result in a homodimeric TALEN when both monomeric TALENs are identical or can result in a heterodimeric TALEN when monomeric TALENs are different. TALENs can be used to induce gene modification in immortalized human cells by means of the two major eukaryotic DNA repair pathways, non-homologous end joining (NHEJ) and homology directed repair.

Various working examples for the introduction of TALENs into cells or embryos, and the formation of animals therefrom are provided herein. Cells for treatment by TALENs include a cultured cell, an immortalized cell, a primary cell, a primary somatic cell, a zygote, a germ cell, a primordial germ cell, a blastocyst, or a stem cell. Example 18 (FIG. 26) details experimental results for modifying spermatogonial stem cells. These cells offer another method for genetic modification of animals, e.g., livestock. Genetic modification or gene edits can be executed in vitro in spermatogonial stem cells (male germ-line stem cells, herein abbreviated GSC's) isolated from donor testes. Modified cells are transplanted into germ-cell depleted testes of a recipient. Implanted spermatogonial stem cells produce sperm that carry the genetic modification(s) that can be used for breeding via artificial insemination (AI) or in vitro fertilization (IVF) to derive founder animals. This method has advantages beyond generation of genetically modified founders. One such advantage is apparent when founders for a particular disease model are unhealthy and not suitable for growth to reproductive age. The same modifications introduced into GSC's could thus be implanted into the testes of a healthy individuals allowing propagation of the line from a healthy animal to generate disease models in newborn piglets.

In some embodiments, a monomeric TALEN can be used. TALENs typically function as dimers across a bipartite recognition site with a spacer, such that two TAL effector domains are each fused to a catalytic domain of the FokI restriction enzyme, the DNA-recognition sites for each resulting TALEN are separated by a spacer sequence, and binding of each TALEN monomer to the recognition site allows FokI to dimerize and create a double-strand break within the spacer. Monomeric TALENs also can be constructed, however, such that single TAL effectors are fused to a nuclease that does not require dimerization to function. One such nuclease, for example, is a single-chain variant of FokI in which the two monomers are expressed as a single polypeptide. Other naturally occurring or engineered monomeric nucleases also can serve this role. The DNA recognition domain used for a monomeric TALEN can be derived from a naturally occurring TAL effector. Alternatively, the DNA recognition domain can be engineered to recognize a specific DNA target. Engineered single-chain TALENs may be easier to construct and deploy, as they require only one engineered DNA recognition domain. A dimeric DNA sequence-specific nuclease can be generated using two different DNA binding domains (e.g., one TAL effector binding domain and one binding domain from another type of molecule). TALENs may function as dimers across a bipartite recognition site with a spacer. This nuclease architecture also can be used for target-specific nucleases generated from, for example, one TALEN monomer and one zinc finger nuclease monomer. In such cases, the DNA recognition sites for the TALEN and zinc finger nuclease monomers can be separated by a spacer of appropriate length. Binding of the two monomers can allow FokI to dimerize and create a double-strand break within the spacer sequence. DNA binding domains other than zinc fingers, such as homeodomains, myb repeats or leucine zippers, also can be fused to FokI and serve as a partner with a TALEN monomer to create a functional nuclease.

In some embodiments, a TAL effector can be used to target other protein domains (e.g., non-nuclease protein domains) to specific nucleotide sequences. For example, a TAL effector can be linked to a protein domain from, without limitation, a DNA 20 interacting enzyme (e.g., a methylase, a topoisomerase, an integrase, a transposase, or a ligase), a transcription activators or repressor, or a protein that interacts with or modifies other proteins such as histones. Applications of such TAL effector fusions include, for example, creating or modifying epigenetic regulatory elements, making site-specific insertions, deletions, or repairs in DNA, controlling gene expression, and modifying chromatin structure.

The spacer of the target sequence can be selected or varied to modulate TALEN specificity and activity. The flexibility in spacer length indicates that spacer length can be chosen to target particular sequences with high specificity. Further, the variation in activity has been observed for different spacer lengths indicating that spacer length can be chosen to achieve a desired level of TALEN activity.

Figure 18:
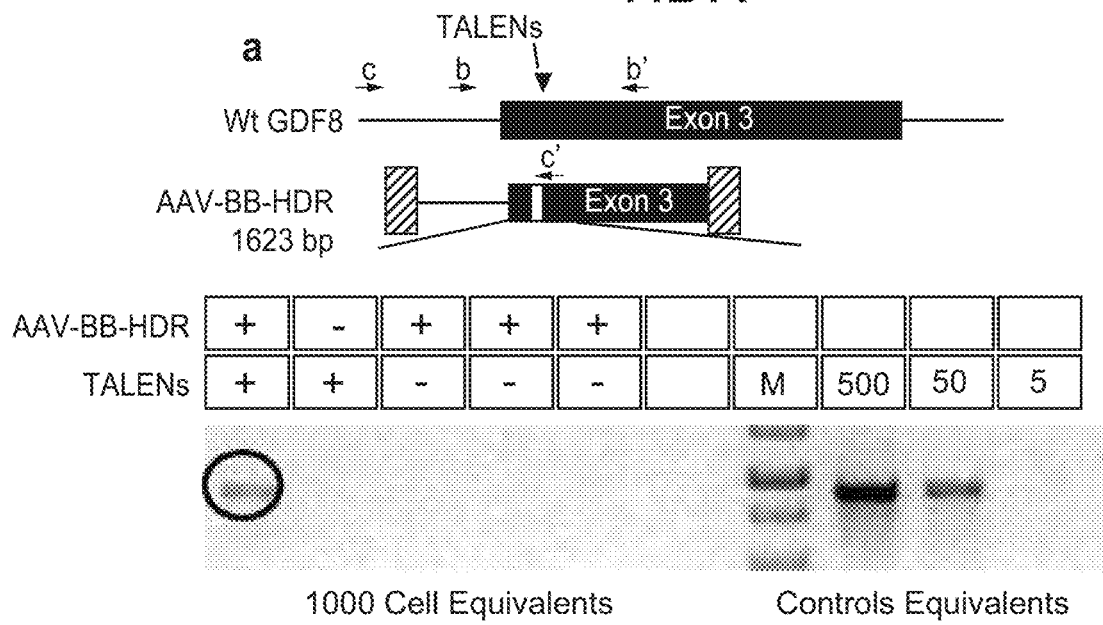
FIG. 18: Use of an AAV-delivered single stranded DNA template emplate for homologous recombination at the *bovine* GDF8 locus. a) TALENs (btGDF83.1, blue arrow) and a rAAV homologous recombination template (AAV-BB-HDR) were designed to introduce an 11 bp deletion into exon-3 of the *bovine* GDF8 gene (Belgium Blue mutation) by homologous recombination. b) Allele-specific PCR demonstrates that HR induction is dependent on transfection btGDF83.1 TALENs and infection with defective AAV containing the AAV-BB-HDR template. The PCR assay was developed to specifically detect HDR modified GDF8 alleles using primers c and c' (shown panel a). The 3' end of primer c' spans the 11 bp deletion, and cannot amplify the wild type allele "WT". 1,000 cell equivalents were included in each PCR reaction and positive control reactions with the indicated copy number of a control template were used for comparative quantification of homologous recombination.

The TALENs described herein as Carlson +63 were surprisingly found to be very efficient in use. A comparison to the most similar TALENs is shown in FIGS. 16 and 18. Referring to FIG. 16 and using the position numbers therein, there is a leading N-terminal portion from about 1 to about 42, a 5' portion from about 43 to about 178, and RVD portion from about 179 to about 197, a +63 domain from about 198 to about 261, and a FokI portion from about 262 to the end at about 400. A number of residues are different between the sequences, for instance at about 10 positions that are circled in FIG. 16A. The N-terminal leader portion is also different, with the Carlson +63 TALEN being about 20 residues shorter and having about 16 other differences. Embodiments of the N-terminal leader portion are sequences of between about 10 to about 30 residues; artisans will immediately appreciate that all the ranges and values within the explicitly stated ranges are contemplated.

FIG. 17 provides a sequence listing for the vector used with the Carlson +63 sequence. Some parts of the vector are indicated in the Figure: the T3 primer binding site, a 5' UTR, the TALEN 5' for Carlson +63, a LacZ-stuffer fragment (see Cermak et. al. 2011 for blue white screening of clones), a Fok I homodimer, a 3' TALEN+18-+63 (note that 3' TALEN+1-17 provided by last TALEN repeat in final cloning step), a 3' UTR-polyA, and a Poly-C that potentially protects the mRNA from degradation. In use, as is known to artisans, the amino acids that provide specific binding are inserted in between the portions labeled as the 5' portion and the half RVD sequence. FIG. 17 shows the Carlson +63 TALEN scaffold with various features for production of mRNA. The vector has some features in common with a pT3TS plasmid previously described (Hyatt, T. M. & Ekker, S. C. Vectors and techniques for ectopic gene expression in zebrafish. Methods Cell Biol 59, 117-126 (1999)). A significant improvement to the Hyatt et al. vector was made by removal of a LacZ promoter that was previously located 5' of the T3 promoter sequence indicated in FIG. 17. Removal of the LacZ promoter was found to be required for reliable cloning of gene specific TALENs and propagation of the plasmid. The Carlson +63 vector has a T3 site for mRNA transcription with T3 mRNA polymerase. The features include a T3 promoter binding site from which transcription can be initiated, 5' and 3' UTR sequence from the Xenopus β-globin gene, and a poly-C stretch. The 5' and 3' portions of the TALEN scaffold flank a LacZ stuffer fragment that is removed when the gene specific RVD sequences are cloned in as described in Cermak, T. et al. Efficient design and assembly of custom TALEN and other TAL effector-based constructs for DNA targeting. Nucleic Acids Research 39, e82 (2011).

Alternative embodiments use alternative mRNA polymerases and cognate binding sites such as T7 or SP6. Other embodiments relate to the use of any of several alterations of the UTR sequences; these could benefit translation of the mRNA. Some examples are: addition of a cytoplasmic polyadenylation element binding site in the 3' UTR, or exchanging the Xenopus β-globin UTRs with UTR sequences from human, pig, cow, sheep, goat, zebrafish, from genes including B-globin. UTRs from genes may be selected for regulation of expression in embryonic development or in cells. Some examples of UTRs that may be useful include β-actin, DEAH (SEQ ID NO: 527), TPT1, ZF42, SKP1, TKT, TP3, DDX5, EIF3A, DDX39, GAPDH, CDK1, Hsp90ab1, Ybx1 f Eif4b Rps27a Stra13, Myc, Paf1 and Foxo1, or CHUK. Such vector or mRNA improvements could be used to direct special or temporal expression of ectopic TALENs for study of gene depletion at desired stages of development. TALEN mRNA produced by these vectors are generally useful as described herein, including, for example, for creation of knockout or knockin cells lines or animals to generate models of disease, animal improvement or screening of for genes that interact with environmental stimuli (example; drugs, heat, cold, UV light, growth factors, stress).

Embodiments include a vector comprising a sequence having 85% to 100% identity with the Carlson +63 vector or TALEN; artisans will immediately appreciate that all the ranges and values within the explicitly stated ranges are contemplated, e.g., 85%, 90%, and 95%. Embodiments include a Carlson +63 TALEN with a number of conservative substitutions ranging from 1 to 50; artisans will immediately appreciate that all the ranges and values within the explicitly stated ranges are contemplated, e.g., 5 to 10, 1 to 20, or about 12. Artisans will immediately appreciate that the RVD portions of these sequences are to be excluded from these comparisons since the RVD sequences are to be changed according to the target intended by a user. Embodiments include a TALEN that comprises at least one portion of a Carlson +63 TALEN chosen from the group consisting of N-terminal leader portion, 5' portion, and +63 domain (and % variations/substitutions thereof).

The Carlson +63 TALEN has a 22-residue N-terminal leader sequence of MASSPPKKKRKVSWKDASGWSR (SEQ ID NO: 132). Embodiments include a TALEN vector or mRNA that comprises at least one portion of a Carlson +63 TALEN vector chosen from the group consisting of 3' primer biding site, 5'UTR, lacz stuffer fragment, 3' TALEN, 3'UTR, PolyC, and nucleic acids encoding the Carlson +63 N-terminal leader portion, 5' portion, or +63 domain (and variations/substitutions thereof). Alternatively, a sequence may be assembled using one or more of the alternatives indicated above, e.g., for T7 or SP6 or any of the various alternative UTRs. Embodiments include sequences with between 85% and 100% identity to the same, as well as a number of conservative substitutions ranging from 0 to 50.

In some embodiments, a monomeric TALEN can be used. TALEN typically function as dimers across a bipartite recognition site with a spacer, such that two TAL effector domains are each fused to a catalytic domain of the FokI restriction enzyme, the DNA-recognition sites for each resulting TALEN are separated by a spacer sequence, and binding of each TALEN monomer to the recognition site allows FokI to dimerize and create a double-strand break within the spacer. Monomeric TALENs also can be constructed, however, such that single TAL effectors are fused to a nuclease that does not require dimerization to function. One such nuclease, for example, is a single-chain variant of FokI in which the two monomers are expressed as a single polypeptide. Other naturally occurring or engineered monomeric nucleases also can serve this role. The DNA recognition domain used for a monomeric TALEN can be derived from a naturally occurring TAL effector. Alternatively, the DNA recognition domain can be engineered to recognize a specific DNA target. Engineered single-chain TALENs may be easier to construct and deploy, as they require only one engineered DNA recognition domain. A dimeric DNA sequence-specific nuclease can be generated using two different DNA binding domains (e.g., one TAL effector binding domain and one binding domain from another type of molecule). TALENs may function as dimers across a bipartite recognition site with a spacer. This nuclease architecture also can be used for target-specific nucleases generated from, for example, one TALEN monomer and one zinc finger nuclease monomer. In such cases, the DNA recognition sites for the TALEN and zinc finger nuclease monomers can be separated by a spacer of appropriate length. Binding of the two monomers can allow FokI to dimerize and create a double-strand break within the spacer sequence. DNA binding domains other than zinc fingers, such as homeodomains, myb repeats or leucine zippers, also can be fused to FokI and serve as a partner with a TALEN monomer to create a functional nuclease.

The term nuclease includes exonucleases and endonucleases. The term endonuclease refers to any wild-type or variant enzyme capable of catalyzing the hydrolysis (cleavage) of bonds between nucleic acids within a DNA or RNA molecule, preferably a DNA molecule. Non-limiting examples of endonucleases include type II restriction endonucleases such as FokI, HhaI, HindIII, NotI, BbvCI, EcoRI, BglII, and AlwI. Endonucleases comprise also rare-cutting endonucleases when having typically a polynucleotide recognition site of about 12-45 basepairs (bp) in length, more preferably of 14-45 bp. Rare-cutting endonucleases induce DNA double-strand breaks (DSBs) at a defined locus. Rare-cutting endonucleases can for example be a homing endonuclease, a chimeric Zinc-Finger nuclease (ZFN) resulting from the fusion of engineered zinc-finger domains with the catalytic domain of a restriction enzyme such as FokI or a chemical endonuclease. In chemical endonucleases, a chemical or peptidic cleaver is conjugated either to a polymer of nucleic acids or to another DNA recognizing a specific target sequence, thereby targeting the cleavage activity to a specific sequence. Chemical endonucleases also encompass synthetic nucleases like conjugates of orthophenanthroline, a DNA cleaving molecule, and triplex-forming oligonucleotides (TFOs), known to bind specific DNA sequences. Such chemical endonucleases are comprised in the term "endonuclease" according to the present invention. Examples of such endonuclease include I-See I, I-Chu I, I-Cre I, I-Csm I, PI-See L PI-Tti L PI-Mtu I, I-Ceu I, I-See IL I-See III, HO, PI-Civ I, PI-Ctr L PI-Aae I, PI-Bsu PI-Dha I, PI-Dra L PI May L PI-Meh I, PI-Mfu L PI-Mfl I, PI-Mga L PI-Mgo I, PI-Min L PI-Mka L PI-Mle I, PI-Mma I, PI-30 Msh L PI-Msm I, PI-Mth I, PI-Mtu I, PI-Mxe I, PI-Npu I, PI-Pfu L PI-Rma I, PI-Spb I, PI-Ssp L PI-Fae L PI-Mja I, PI-Pho L PI-Tag L PI-Thy I, PI-Tko I, PI-Tsp I, I-MsoI.

A genetic modification made by TALENs or other tools may be, for example, chosen from the list consisting of an insertion, a deletion, insertion of an exogenous nucleic acid fragment, and a substitution. The term "insertion" is used broadly to mean either literal insertion into the chromosome or use of the exogenous sequence as a template for repair. In general, a target DNA site is identified and a TALEN-pair is created that will specifically bind to the site. The TALEN is delivered to the cell or embryo, e.g., as a protein, mRNA or by a vector that encodes the TALEN. The TALEN cleaves the DNA to make a double-strand break that is then repaired, often resulting in the creation of an indel, or incorporating sequences or polymorphisms contained in an accompanying exogenous nucleic acid that is either inserted into the chromosome or serves as a template for repair of the break with a modified sequence. This template-driven repair is a useful process for changing a chromosome, and provides for effective changes to cellular chromosomes.

The term exogenous nucleic acid means a nucleic acid that is added to the cell or embryo, regardless of whether the nucleic acid is the same or distinct from nucleic acid sequences naturally in the cell. In some cases, the exogenous nucleic acid differs in sequence from any nucleic acid sequence that occurs naturally within the cell. The term nucleic acid fragment is broad and includes a chromosome, expression cassette, gene, DNA, RNA, mRNA, or portion thereof. The cell or embryo may be, for instance, chosen from the group consisting of livestock, an artiodactyl, cattle, a swine, a sheep, a goat, a chicken, a rabbit, and a fish. The term "livestock" means domesticated animals that are raised as commodities for food or biological material. The term artiodactyl means a hoofed mammal of the order Artiodactyla, which includes cattle, deer, camels, hippopotamuses, sheep, and goats, that have an even number of toes, usually two or sometimes four, on each foot.

Some embodiments involve a composition or a method of making a genetically modified livestock and/or artiodactyl comprising introducing a TALEN-pair into livestock and/or an artiodactyl cell or embryo that makes a genetic modification to DNA of the cell or embryo at a site that is specifically bound by the TALEN-pair, and producing the livestock animal/artiodactyl from the cell. Direct injection may be used for the cell or embryo, e.g., into a zygote, blastocyst, or embryo. Alternatively, the TALEN and/or other factors may be introduced into a cell using any of many known techniques for introduction of proteins, RNA, mRNA, DNA, or vectors. Genetically modified animals may be made from the embryos or cells according to known processes, e.g., implantation of the embryo into a gestational host, or various cloning methods. The phrase "a genetic modification to DNA of the cell at a site that is specifically bound by the TALEN", or the like, means that the genetic modification is made at the site cut by the nuclease on the TALEN when the TALEN is specifically bound to its target site. The nuclease does not cut exactly where the TALEN-pair binds, but rather at a defined site between the two binding sites.

Some embodiments involve a composition or a treatment of a cell that is used for cloning the animal. The cell may be a livestock and/or artiodactyl cell, a cultured cell, a primary cell, a primary somatic cell, a zygote, a germ cell, a primordial germ cell, or a stem cell. For example, an embodiment is a composition or a method of creating a genetic modification comprising exposing a plurality of primary cells in a culture to TALEN proteins or a nucleic acid encoding a TALEN or TALENs. The TALENs may be introduced as proteins or as nucleic acid fragments, e.g., encoded by mRNA or a DNA sequence in a vector.

Genetic modification of cells may also include insertion of a reporter. The reporter may be, e.g., a florescent marker, e.g., green fluorescent protein and yellow fluorescent protein. The reporter may be a selection marker, e.g., puromycin, ganciclovir, adenosine deaminase (ADA), aminoglycoside phosphotransferase (neo, G418, APH), dihydrofolate reductase (DHFR), hygromycin-B-phosphtransferase, thymidine kinase (TK), or xanthin-guanine phosphoribosyltransferase (XGPRT). Vectors for the reporter, selection marker, and/or one or more TALEN may be a plasmid, transposon, transposase, viral, or other vectors, e.g., as detailed herein.

TALENs may be directed to a plurality of DNA sites. The sites may be separated by several thousand or many thousands of base pairs. The DNA can be rejoined by cellular machinery to thereby cause the deletion of the entire region between the sites. Embodiments include, for example, sites separated by a distance between 1-5 megabases or between 50% and 80% of a chromosome, or between about 100 and about 1,000,000 basepairs; artisans will immediately appreciate that all the ranges and values within the explicitly stated ranges are contemplated, e.g., from about 1,000 to about 10,000 basepairs or from about 500 to about 500,000 basepairs. Alternatively, exogenous DNA may be added to the cell or embryo for insertion of the exogenous DNA, or template-driven repair of the DNA between the sites. Modification at a plurality of sites may be used to make genetically modified cells, embryos, artiodactyls, and livestock. One or more genes may be chosen for complete or at least partial deletion, including a sexual maturation gene or a cis-acting factor thereof.

Figure 26:
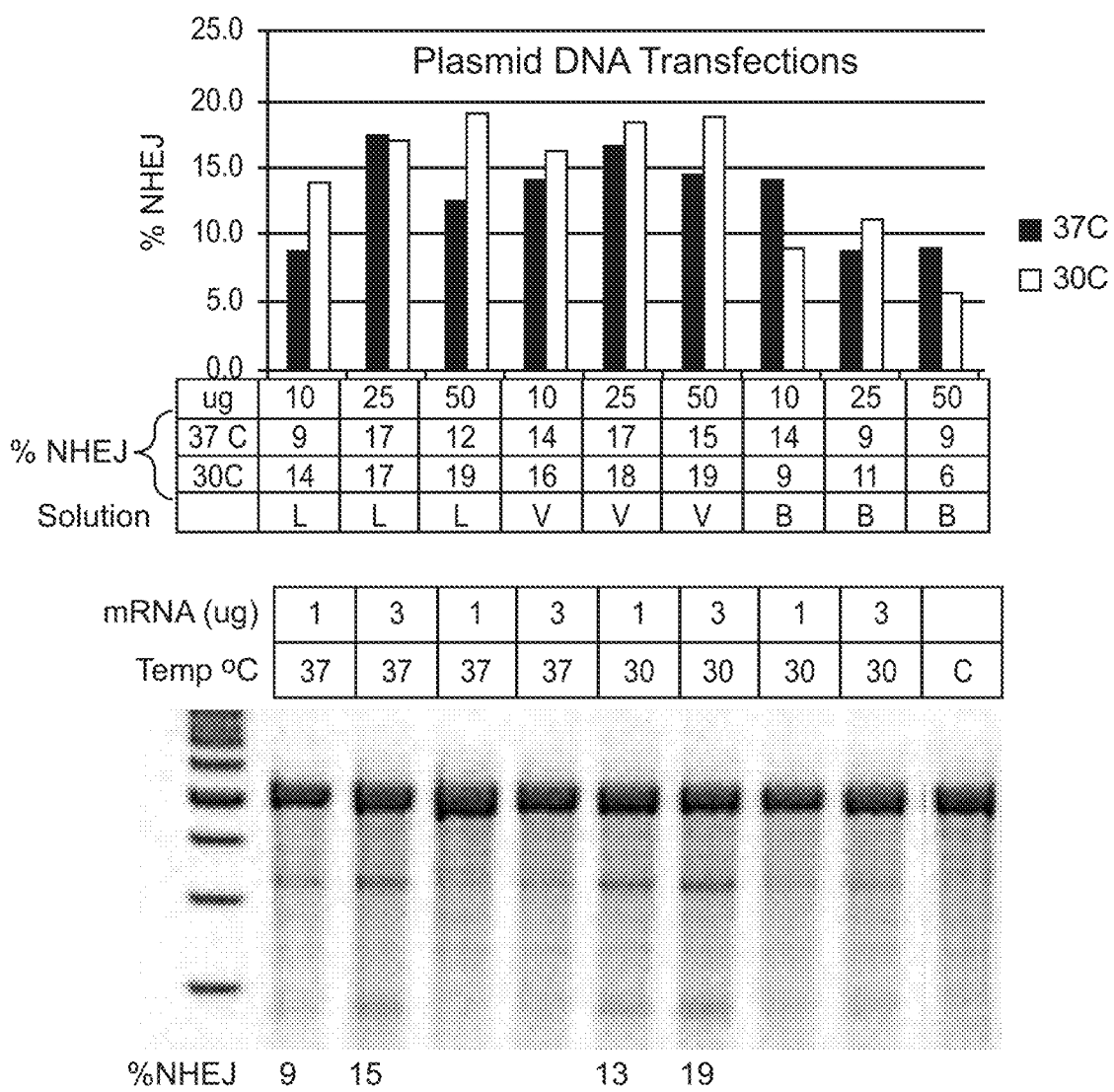
FIG. 26: DNA and mRNA encoded TALENs are active in stem cells. The top panel shows percent NHEJ of DMD7.1 TALENs transfected as plasmid DNA into porcine male germ-line stem cells (GSCs). Nucleofection solutions L, V or B were evaluated. The lower panel shows SURVEYOR assay results of porcine GSCs transfected with mRNA encoding DMD7.1 TALENs. The quantity of mRNA (micrograms) is indicated.
Figure 28:
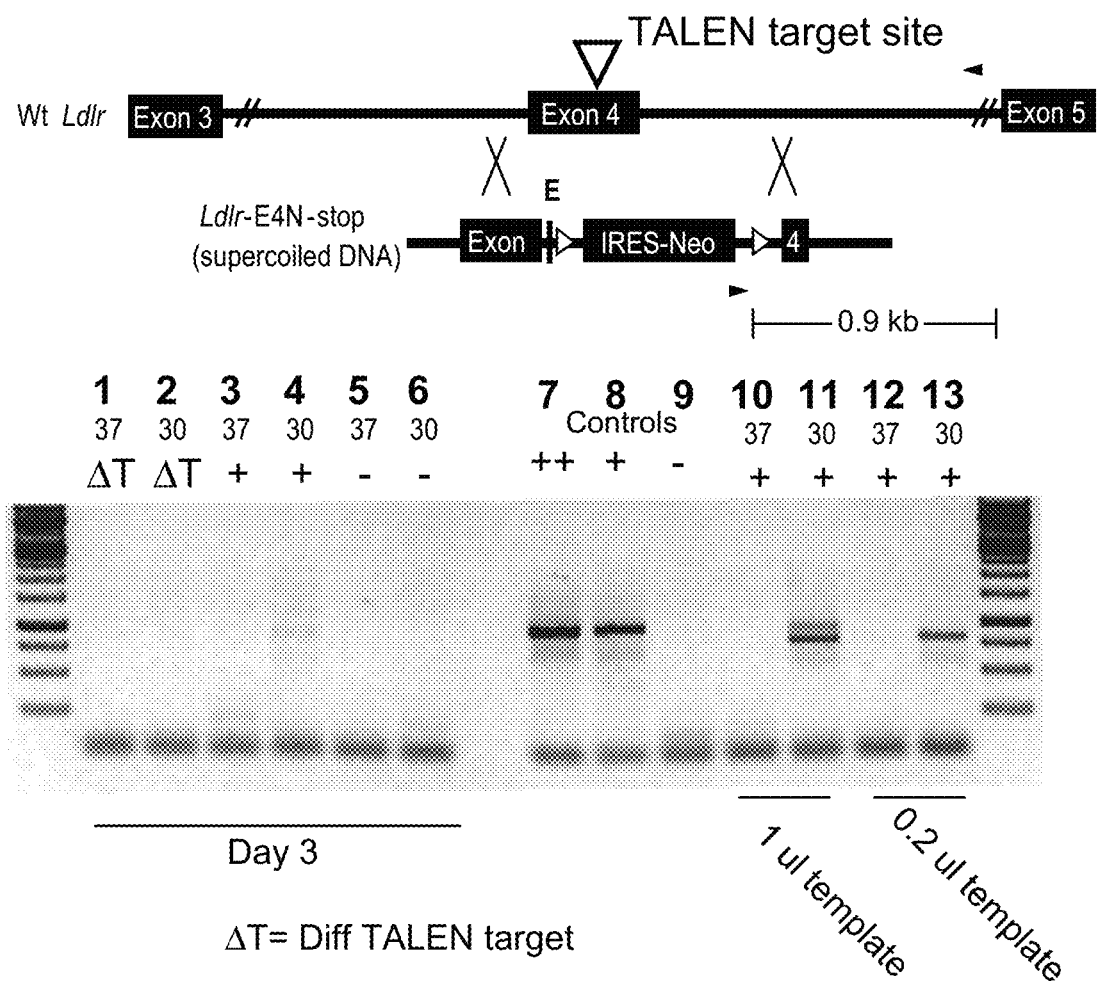
FIG. 28: Schematic and gel for the TALEN-mediated HDR of FIG. 27.
Figure 29:
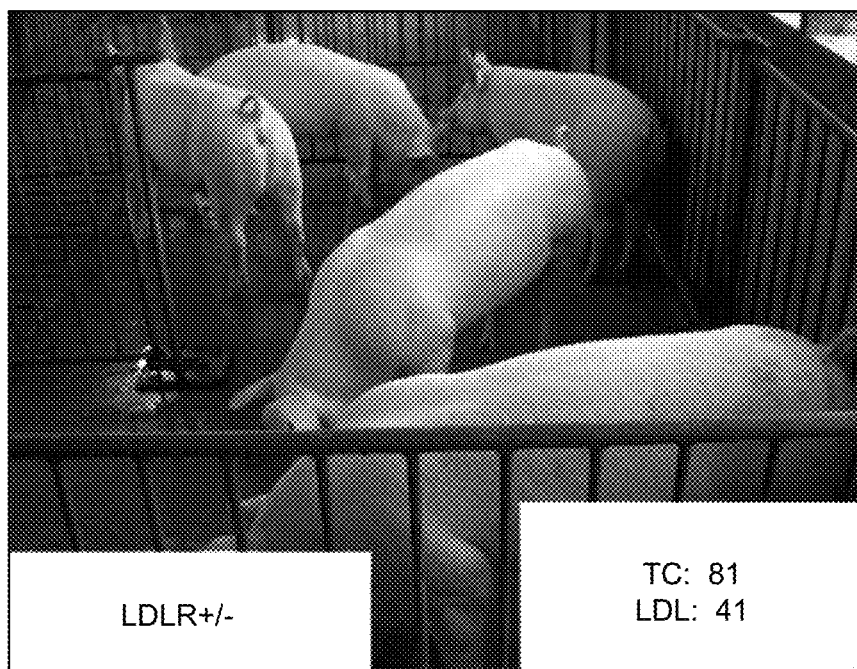
FIG. 29: Transgenic swine created by the processes of FIGS. 27 and 28.
Figure 30:
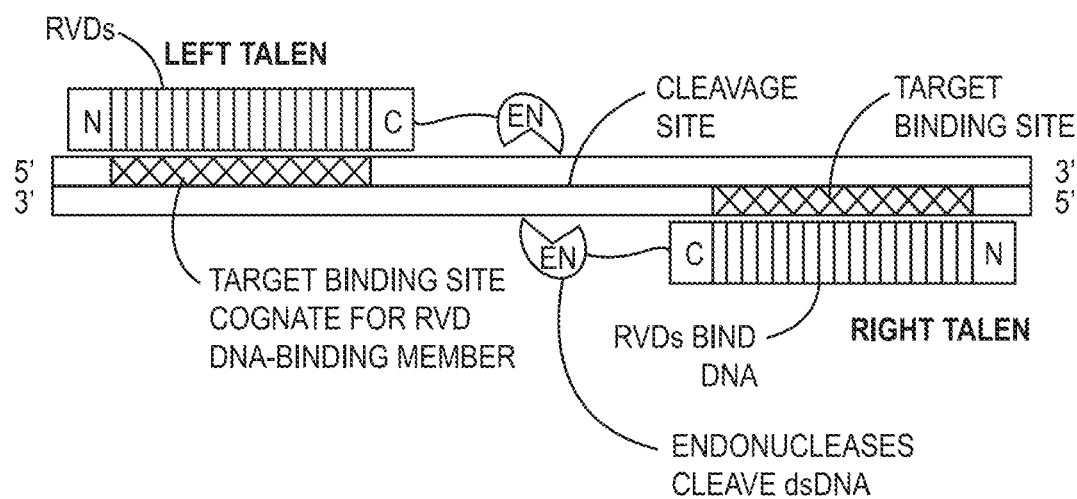
FIG. 30: Illustrates a general process of using a TAL-effector endonuclease (TALEN).
Figure 31:
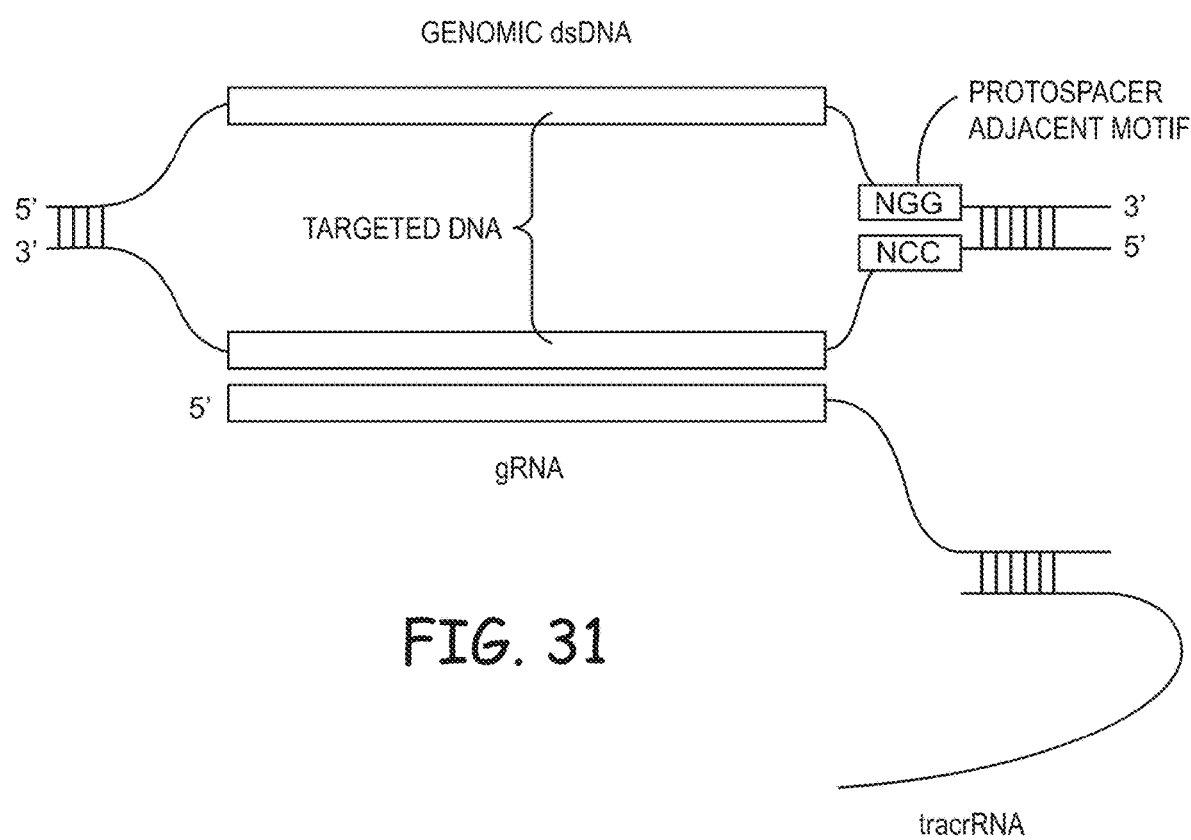
FIG. 31: Illustrates a general process of using a Cas9/CRISPR endonuclease (an RNA-guided endonuclease).
Figure 32:
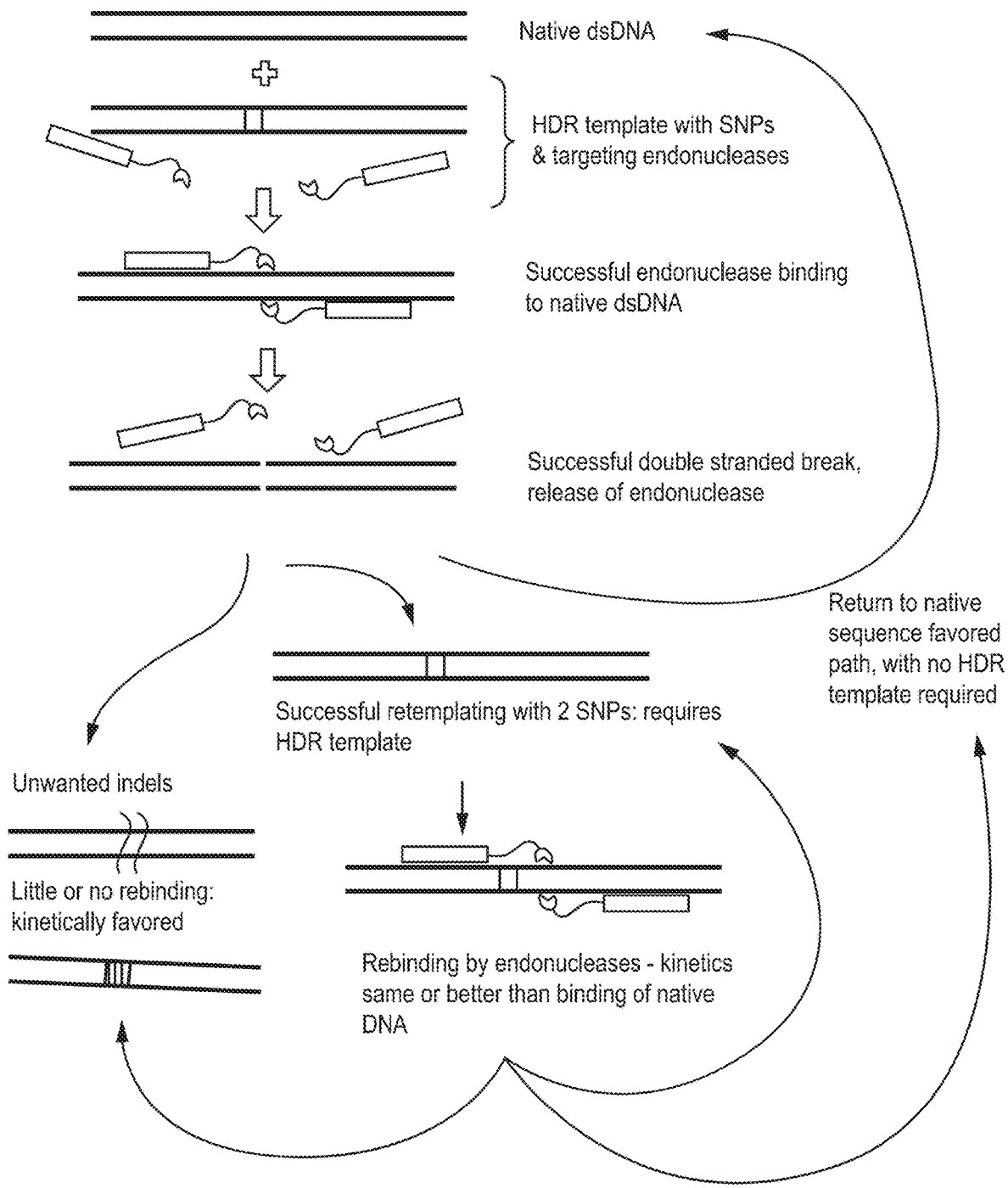
FIG. 32: Illustrates the theory of operation for TALENs that explains why they are generally ineffective for making SNP changes; similar processes apply to other targeted endonucleases.
Figure 33:
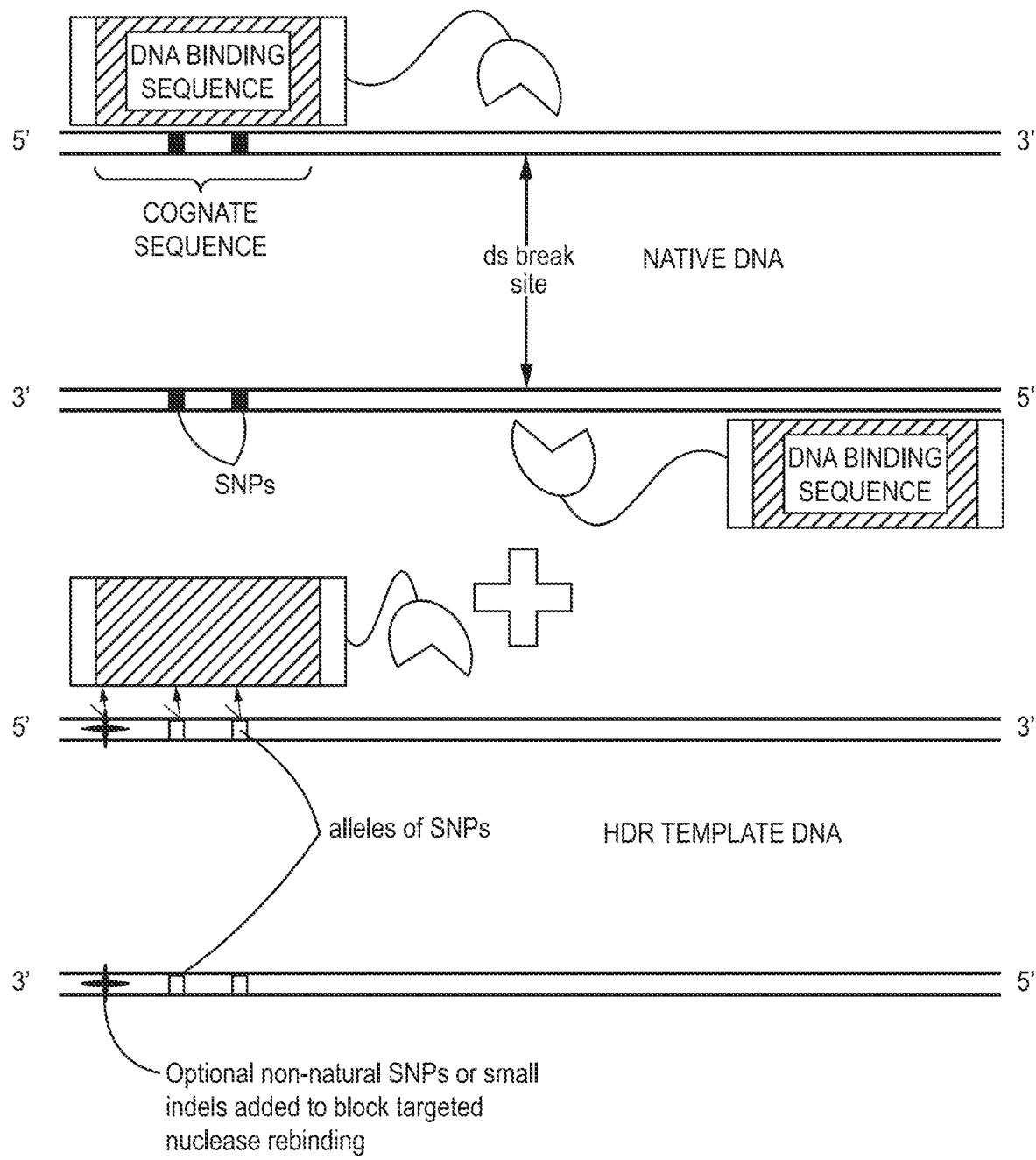
FIG. 33: Illustrates a general method of making and using targeting endonucleases that is effective to make an SNP edit.
Figure 34:
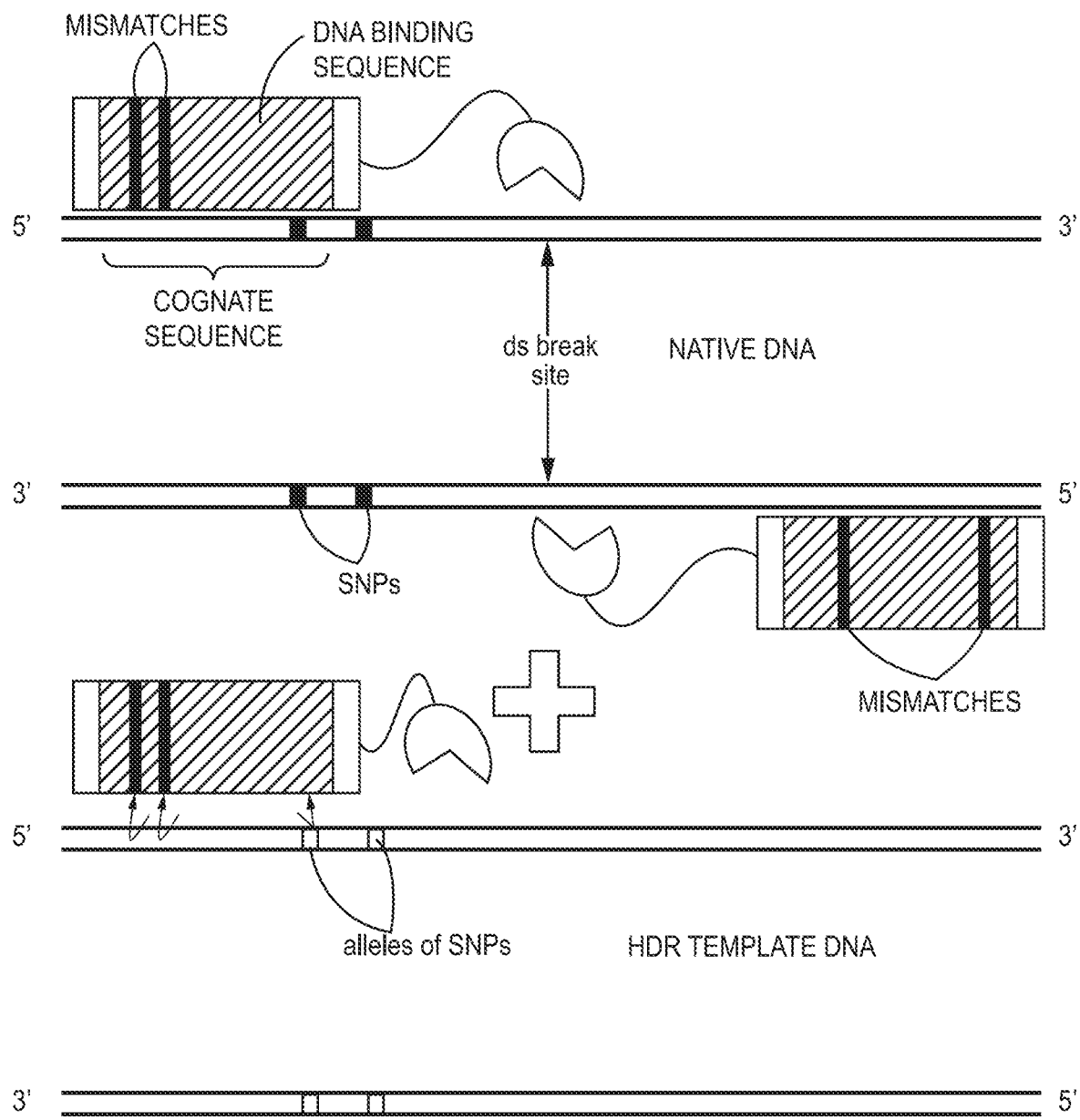
FIG. 34: Illustrates another general method of making and using targeting endonucleases that is effective to make an SNP edit.

The possibility and efficiency of generating TALEN-mediated indels in spermatogonial stem cells was explored by transfection of plasmids encoding TALENs targeted to exon 7 of the porcine Duchene Muscular Dystrophy locus (DMD). Testing of several nuclefection conditions, plasmid quantities and incubation temperature yielded a maximum efficiency of 19% NHEJ despite a germ cell transfection rate of 25%, as shown in FIG. 26. TALEN activity was highest in replicates cultured at 30° C. GSCs remained viable after over 5 days of culture at 30° C., though overall, germ cell survival was higher at 37° C. Transfection of TALEN encoding mRNA, versus plasmid DNA, resulted in both greater activity and viability of livestock somatic cells and GSCs. Notably, while peak activity of mRNA transfection did not exceed plasmid DNA transfection in this experiment, a significantly lower quantity of mRNA was required to achieve the same level of modification. Example 19 details successful TALEN-stimulated HDR in primordial germ cells (avian).

In some embodiments, a monomeric TALEN can be used. TALEN typically function as dimers across a bipartite recognition site with a spacer, such that two TAL effector domains are each fused to a catalytic domain of the FokI restriction enzyme, the DNA-recognition sites for each resulting TALEN are separated by a spacer sequence, and binding of each TALEN monomer to the recognition site allows FokI to dimerize and create a double-strand break within the spacer. Monomeric TALENs also can be constructed, however, such that single TAL effectors are fused to a nuclease that does not require dimerization to function. One such nuclease, for example, is a single-chain variant of FokI in which the two monomers are expressed as a single polypeptide. Other naturally occurring or engineered monomeric nucleases also can serve this role. The DNA recognition domain used for a monomeric TALEN can be derived from a naturally occurring TAL effector. Alternatively, the DNA recognition domain can be engineered to recognize a specific DNA target. Engineered single-chain TALENs may be easier to construct and deploy, as they require only one engineered DNA recognition domain. A dimeric DNA sequence-specific nuclease can be generated using two different DNA binding domains (e.g., one TAL effector binding domain and one binding domain from another type of molecule). TALENs may function as dimers across a bipartite recognition site with a spacer. This nuclease architecture also can be used for target-specific nucleases generated from, for example, one TALEN monomer and one zinc finger nuclease monomer. In such cases, the DNA recognition sites for the TALEN and zinc finger nuclease monomers can be separated by a spacer of appropriate length. Binding of the two monomers can allow FokI to dimerize and create a double-strand break within the spacer sequence. DNA binding domains other than zinc fingers, such as homeodomains, myb repeats or leucine zippers, also can be fused to FokI and serve as a partner with a TALEN monomer to create a functional nuclease.

Recombinases

Embodiments of the invention include administration of a TALEN or TALENs with a recombinase or other DNA-binding protein associated with DNA recombination. A recombinase forms a filament with a nucleic acid fragment and, in effect, searches cellular DNA to find a DNA sequence substantially homologous to the sequence. An embodiment of a TALEN-recombinase embodiment comprises combining a recombinase with a nucleic acid sequence that serves as a template for HDR. The HDR template sequence has substantial homology to a site that is targeted for cutting by the TALEN/TALEN pair. As described herein, the HDR template provides for a change to the native DNA, by placement of an allele, creation of an indel, insertion of exogenous DNA, or with other changes. The TALEN is placed in the cell or embryo by methods described herein as a protein, mRNA, or by use of a vector. The recombinase is combined with the HDR template to form a filament and placed into the cell. The recombinase and/or HDR template that combines with the recombinase may be placed in the cell or embryo as a protein, an mRNA, or with a vector that encodes the recombinase. The disclosure of US Pub 2011/0059160 (U.S. Ser. No. 12/869,232) is hereby incorporated herein by reference for all purposes; in case of conflict, the specification is controlling. The term recombinase refers to a genetic recombination enzyme that enzymatically catalyzes, in a cell, the joining of relatively short pieces of DNA between two relatively longer DNA strands. Recombinases include Cre recombinase, Hin recombinase, RecA, RAD51, Cre, and FLP. Cre recombinase is a Type I topoisomerase from P1 bacteriophage that catalyzes site-specific recombination of DNA between loxP sites. Hin recombinase is a 21 kD protein composed of 198 amino acids that is found in the bacteria *Salmonella*. Hin belongs to the serine recombinase family of DNA invertases in which it relies on the active site serine to initiate DNA cleavage and recombination. RAD51 is a human gene. The protein encoded by this gene is a member of the RAD51 protein family which assist in repair of DNA double strand breaks. RAD51 family members are homologous to the bacterial RecA and yeast Rad51 genes. Cre recombinase is an enzyme that is used in experiments to delete specific sequences that are flanked by loxP sites. FLP refers to Flippase recombination enzyme (FLP or Flp) derived from the 2µ plasmid of the baker's yeast *Saccharomyces cerevisiae*.

Herein, "RecA" or "RecA protein" refers to a family of RecA-like recombination proteins having essentially all or most of the same functions, particularly: (i) the ability to position properly oligonucleotides or polynucleotides on their homologous targets for subsequent extension by DNA polymerases; (ii) the ability topologically to prepare duplex nucleic acid for DNA synthesis; and, (iii) the ability of RecA/oligonucleotide or RecA/polynucleotide complexes efficiently to find and bind to complementary sequences. The best characterized RecA protein is from *E. coli*; in addition to the original allelic form of the protein a number of mutant RecA-like proteins have been identified, for example, RecA803. Further, many organisms have RecA-like strand-transfer proteins including, for example, yeast, *Drosophila*, mammals including humans, and plants. These proteins include, for example, Rec1, Rec2, Rad51, Rad51B, Rad51C, Rad51D, Rad51E, XRCC2 and DMC1. An embodiment of the recombination protein is the RecA protein of *E. coli*. Alternatively, the RecA protein can be the mutant RecA-803 protein of *E. coli*, a RecA protein from another bacterial source or a homologous recombination protein from another organism.

RecA is known for its recombinase activity to catalyze strand exchange during the repair of double-strand breaks by homologous recombination (McGrew and Knight, 2003) Radding, et al., 1981; Seitz et al., 1998). RecA has also been shown to catalyze proteolysis, e.g., of the LexA and λ repressor proteins, and to possess DNA-dependent ATPase activity. After a double-strand break occurs from ionizing radiation or some other insult, exonucleases chew back the DNA ends 5' to 3', thereby exposing one strand of the DNA (Cox, 1999; McGrew and Knight, 2003). The single-stranded DNA becomes stabilized by single-strand binding protein (SSB). After binding of SSB, RecA binds the single-stranded (ss) DNA and forms a helical nucleoprotein filament (referred to as a filament or a presynaptic filament). During DNA repair, the homology-searching functions of RecA direct the filament to homologous DNA and catalyze homologous base pairing and strand exchange. This results in the formation of DNA heteroduplex. After strand invasion, DNA polymerase elongates the ssDNA based on the homologous DNA template to repair the DNA break, and crossover structures or Holliday junctions are formed. RecA also shows a motor function that participates in the migration of the crossover structures (Campbell and Davis, 1999).

Recombinase activity comprises a number of different functions. For example, polypeptide sequences having recombinase activity are able to bind in a non-sequence-specific fashion to single-stranded DNA to form a nucleoprotein filament. Such recombinase-bound nucleoprotein filaments are able to interact in a non-sequence-specific manner with a double-stranded DNA molecule, search for sequences in the double-stranded molecule that are homologous to sequences in the filament, and, when such sequences are found, displace one of the strands of the double-stranded molecule to allow base-pairing between sequences in the filament and complementary sequences in one of the strands of the double stranded molecule. Such steps are collectively denoted "synapsis."

RecA and RecA-like proteins (called Rad51 in many eukaryotic species) have been examined for stimulating gene targeting and homologous recombination in a variety of eukaryotic systems. In tobacco cells, expression of bacterial RecA containing a nuclear localization signal (NLS) increases the repair of mitomycin C-induced DNA damage by homologous recombination and somatic intrachromosomal recombination (recombination between homologous chromosomes) from three to ten fold (Reiss et al., 1996). Expression of NLSRecA in tobacco can also stimulate sister chromatid exchange 2.4-fold over wild-type levels (Reiss et al., 2000). In somatic mammalian cells, overexpression of NLSRecA stimulates gene-targeting by homologous recombination 10-fold (Shcherbakova et al., 2000). However, in human cells, overexpression of a human homologue of RecA, hRAD51, only stimulates recombination 2 to 3-fold over wild type levels under the antibiotic selection (Yanez and Porter, 1999). In zebrafish, a mutant form of the enhanced green fluorescent protein (EGFP) was corrected at low frequency by injecting ssDNA-RecA filaments directly (Cui et al., 2003). Rad52, a member of the Rad51 epistasis group, also promotes single-strand annealing and low level gene disruption in zebrafish using mutated oligonucleotides (Takahashi and Dawid, 2005). Taken together, these studies indicate that ectopic expression of RecA or Rad51 results in a modest stimulation of homologous recombination but does not increase levels sufficiently to be useful for gene-targeting.

Thus recombinase activities include, but are not limited to, single-stranded DNA-binding, synapsis, homology searching, duplex invasion by single-stranded DNA, heteroduplex formation, ATP hydrolysis and proteolysis. The prototypical recombinase is the RecA protein from *E. coli*. See, for example, U.S. Pat. No. 4,888,274. Prokaryotic RecA-like proteins have also been described in *Salmonella, Bacillus* and *Proteus* species. A thermostable RecA protein, from *Thermus aquaticus*, has been described in U.S. Pat. No. 5,510,473. A bacteriophage T4 homologue of RecA, the UvsX protein, has been described. RecA mutants, having altered recombinase activities, have been described, for example, in U.S. Pat. Nos. 6,774,213; 7,176,007 and 7,294,494. Plant RecA homologues are described in, for example, U.S. Pat. Nos. 5,674,992; 6,388,169 and 6,809,183. RecA fragments containing recombinase activity have been described, for example, in U.S. Pat. No. 5,731,411. Mutant RecA proteins having enhanced recombinase activity such as, for example, RecA803 have been described. See, for example, Madiraju et al. (1988) Proc. Natl. Acad. Sci. USA 85:6592-6596.

A eukaryotic homologue of RecA, also possessing recombinase activity, is the Rad51 protein, first identified in the yeast *Saccharomyces cerevisiae*. See Bishop et al., (1992) Cell 69:439-56; Shinohara et al, (1992) Cell: 457-70; Aboussekhra, et al., (1992) Mol. Cell. Biol. 72, 3224-3234 and Basile et al., (1992) Mol. Cell. Biol. 12, 3235-3246. Plant Rad51 sequences are described in U.S. Pat. Nos. 6,541,684; 6,720,478; 6,905,857 and 7,034,117. Another yeast protein that is homologous to RecA is the Dmc1 protein. RecA/Rad51 homologues in organisms other than *E. coli* and *S. cerevisiae* have been described. Morita et al. (1993) Proc. Natl. Acad. Sci. USA 90:6577-6580; Shinohara et al. (1993) Nature Genet. 4:239-243; Heyer (1994) Experientia 50:223-233; Maeshima et al. (1995) Gene 160:195-200; U.S. Pat. Nos. 6,541,684 and 6,905,857.

Herein, "RecA" or "RecA protein" refers to a family of RecA-like recombination proteins having essentially all or most of the same functions, particularly: (i) the ability to position properly oligonucleotides or polynucleotides on their homologous targets for subsequent extension by DNA polymerases; (ii) the ability topologically to prepare duplex nucleic acid for DNA synthesis; and, (iii) the ability of RecA/oligonucleotide or RecA/polynucleotide complexes efficiently to find and bind to complementary sequences. The best characterized RecA protein is from *E. coli*; in addition to the original allelic form of the protein a number of mutant RecA-like proteins have been identified, for example, RecA803. Further, many organisms have RecA-like strand-transfer proteins including, for example, yeast, *Drosophila*, mammals including humans, and plants. These proteins include, for example, Rec1, Rec2, Rad51, Rad51B, Rad51C, Rad51D, Rad51E, XRCC2 and DMC1. An embodiment of the recombination protein is the RecA protein of *E. coli*. Alternatively, the RecA protein can be the mutant RecA-803 protein of *E. coli*, a RecA protein from another bacterial source or a homologous recombination protein from another organism.

Additional descriptions of proteins having recombinase activity are found, for example, in Fugisawa et al. (1985) Nucl. Acids Res. 13:7473; Hsieh et al. (1986) Cell 44:885; Hsieh et al. (1989) J. Biol. Chem. 264:5089; Fishel et al. (1988) Proc. Natl. Acad. Sci. USA 85:3683; Cassuto et al. (1987) Mol. Gen. Genet. 208:10; Ganea et al. (1987) Mol. Cell Biol. 7:3124; Moore et al. (1990) J. Biol. Chem.:11108; Keene et al. (1984) Nucl. Acids Res. 12:3057; Kimiec (1984) Cold Spring Harbor Symp. 48:675; Kimeic (1986) Cell 44:545; Kolodner et al. (1987) Proc. Natl. Acad. Sci. USA 84:5560; Sugino et al. (1985) Proc. Natl. Acad, Sci. USA 85: 3683; Halbrook et al. (1989) J. Biol. Chem. 264:21403; Eisen et al. (1988) Proc. Natl. Acad. Sci. USA 85:7481; McCarthy et al. (1988) Proc. Natl. Acad. Sci. USA 85:5854; and Lowenhaupt et al. (1989) J. Biol. Chem. 264:20568, which are incorporated herein by reference. See also Brendel et al. (1997) J. Mol. Evol. 44:528.

Examples of proteins having recombinase activity include recA, recA803, uvsX, and other recA mutants and recA-like recombinases (Roca (1990) Crit. Rev. Biochem. Molec. Biol. 25:415), (Kolodner et al. (1987) Proc. Natl. Acad. Sci. U.S.A. 84:5560; Tishkoff et al. (1991) Molec. Cell. Biol. 11:2593), RuvC (Dunderdale et al. (1991) Nature 354:506), DST2, KEM1 and XRN1 (Dykstra et al. (1991) Molec. Cell. Biol. 11:2583), STPa/DST1 (Clark et al. (1991) Molec. Cell. Biol. 11:2576), HPP-1 (Moore et al. (1991) Proc. Natl. Acad. Sci. U.S.A. 88:9067), other eukaryotic recombinases (Bishop et al. (1992) Cell 69:439; and Shinohara et al. (1992) Cell 69:457); incorporated herein by reference.

In vitro-evolved proteins having recombinase activity have been described in U.S. Pat. No. 6,686,515. Further publications relating to recombinases include, for example, U.S. Pat. Nos. 7,732,585, 7,361,641, 7,144,734. For a review of recombinases, see Cox (2001) Proc. Natl. Acad. Sci. USA 98:8173-8180.

A nucleoprotein filament, or "filament" may be formed. The term filament, in the context of forming a structure with a recombinase, is a term known to artisans in these fields. The nucleoprotein filament so formed can then be, e.g., contacted with another nucleic acid or introduced into a cell. Methods for forming nucleoprotein filaments, wherein the filaments comprise polypeptide sequences having recombinase activity and a nucleic acid, are well-known in the art. See, e.g., Cui et al. (2003) Marine Biotechnol. 5:174-184 and U.S. Pat. Nos. 4,888,274; 5,763,240; 5,948,653 and 7,199,281, the disclosures of which are incorporated by reference for the purposes of disclosing exemplary techniques for binding recombinases to nucleic acids to form nucleoprotein filaments.

In general, a molecule having recombinase activity is contacted with a linear, single-stranded nucleic acid. The linear, single-stranded nucleic acid may be a probe. The methods of preparation of such single stranded nucleic acids are known. The reaction mixture typically contains a magnesium ion. Optionally, the reaction mixture is buffered and optionally also contains ATP, dATP or a nonhydrolyzable ATP analogue, such as, for example, γ-thio-ATP (ATP-γ-S) or γ-thio-GTP (GTP-γ-S). Reaction mixtures can also optionally contain an ATP-generating system. Double-stranded DNA molecules can be denatured (e.g., by heat or alkali) either prior to, or during, filament formation. Optimization of the molar ratio of recombinase to nucleic acid is within the skill of the art. For example, a series of different concentrations of recombinase can be added to a constant amount of nucleic acid, and filament formation assayed by mobility in an agarose or acrylamide gel. Because bound protein retards the electrophoretic mobility of a polynucleotide, filament formation is evidenced by retarded mobility of the nucleic acid. Either maximum degree of retardation, or maximum amount of nucleic acid migrating with a retarded mobility, can be used to indicate optimal recombinase:nucleic acid ratios. Protein-DNA association can also be quantitated by measuring the ability of a polynucleotide to bind to nitrocellulose.

Creation of Genetically Modified Livestock Via TALEN Technologies; Verification of TALEN Modification; Co-Selection of Modified Cells; Elimination of Reporter Genes from Genetically Modified Animals TALEN function in livestock embryos was investigated using in vitro prepared (IVP) *bovine* and porcine embryos. Example 1 describes direct injection of TALENs (a left TALEN and a right TALEN) into *bovine* embryos to produce genetically modified animals with a modification at the site where the TALENs specifically bound. The modifications included homozygous-biallelic and heterozygous-biallelic modifications. TALEN mRNAs were directly injected into the embryos and successful genetic modifications were observed. Expression of the reporter was predictive of a successful genetic modification, with about 35% of the embryos expressing the reporter, and about 30% of these animals having a TALEN-based indel. Of the animals with indels, about 35% of them were either homozygous or heterozygous bi-allelic mutants (FIG. 4). Direct embryo modification using TALENs was thus shown to be a viable approach to livestock genome modification. Embryos may thus be prepared and implanted into surrogate females for gestation and delivery of animal founder lines using well known processes. Moreover, it is possible to use a reporter to select cells (e.g., primary cells, zygotes, oocytes, blastocysts) for further use in cloning or other processes.

Figure 7:
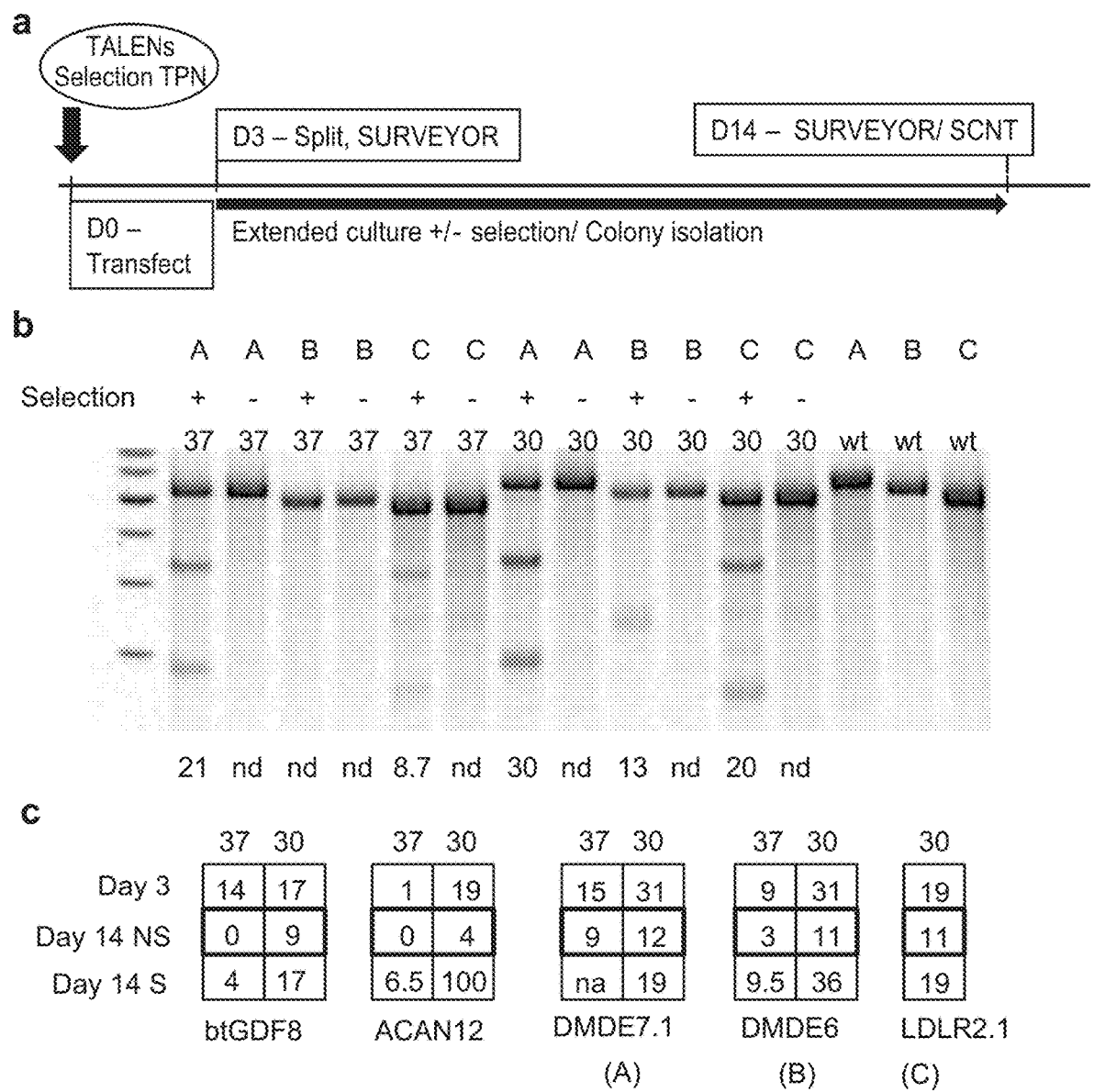
FIG. 7: Transposon co-selection for indel enrichment. An experimental timeline is shown in panel (a). Day zero (D0), cells are transfected with a mixture of plasmids including an expression cassette for each TALEN, a transposon encoding a selection marker, and a transposase-expression cassette. The TALEN plasmid is the major component (4-fold excess by mass) of each transfection. Fibroblasts were cultured in DMEM (high glucose) supplemented to 10% FBS, 20 mm GlutaMAX and 1× Penn/Strep solution (all from Invitrogen) and transfected by using the Basic Fibroblast Nuclofection Kit (Amaxa Biosystems/Lonza) or Minis LT1 reagent (Minis) as previously described (Carlson 2011). Briefly, each transfection included 500,000-1,000,000 fibroblasts, 2 ug each TALEN plasmid and 750 ng of transposon components (500 ng pKT2P-PTK; 200 ng pKC-SB100X; 50 ng pMAX-EGFP (Lonza)). Transfected cells are cultured for 3 days at either 30 or 37 degrees Celsius prior to splitting, collection of a sample for SURVEYOR assay and re-plating for extended culture +/− selection for transposon integration. All cells are cultured at 37 degrees Celsius after day 3. Cells cultured for 14+ days are collected for SURVEYOR assay and cryopreserved for downstream applications, e.g., single-cell nuclear transfer. Panel b) Fibroblasts were transfected using cationic-lipids. No activity was observed at day 3 (due to low transfection efficiency) so only data for day 14+ populations is provided. Temperature treatment, selection, and TALEN id (identified by letters A-C as indicated in panel (c)) are shown above the gel. Panel c) Fibroblasts were transfected by Nucleofection and percent NHEJ was measured at day 3, and in day 14+ non-selected (NS) and selected (S) populations. Temperature treatment is indicated above each matrix. Abbreviations: nd=not detected; wt=wild type amplicon, SURVEYOR treated.

Methods for TALEN-mediated genetic modification of livestock (or zebrafish, dogs, mice, rats, avian, chicken, or a laboratory animal) by cloning were also developed. Example 2 describes development of suitable TALENs and TALEN modification of somatic primary cells of swine and cows. The efficiency of successful modification was somewhat low and no reporters for measuring success of the modification were used. Nucleofection is a means for introducing foreign nucleic acids into a cell with high efficiency, but it is expensive, results in high levels of cytotoxicity, and is not available to many researchers. Therefore, a common cationic lipid transfection reagent was used as a vehicle for genetic modification. As shown in Example 3, despite a less than 5% transfection efficiency with cationic lipids, modification levels were significantly enriched by transposon co-selection. Whereas gene modification was below detection in day 3 populations (data not shown) and day 14 populations without transposon-mediated selection, modification levels in selected populations reached 31, 13 and 20 percent for DMD7.1, DMD6 and LDLR2.1 respectively (FIG. 7). Transposon co-selection was then applied to cells transfected by nucleofection where >90% transfection efficiency is routine. Transposon co-selection was effective for maintenance modified cells transfected by Nucleofection, however, with the exception of ACAN12, nucleofection did not significantly enrich for modified cells over day 3 levels (FIG. 7). Thus, transposon co-selection is an effective enrichment method when transfection efficiency is low and an effective maintenance method when transfection efficiency is high. Co-selection processes were also effective when feeder cells were used, as demonstrated in Example 4. An unexpectedly high proportion of bi-allelic modifications (about 17% to about 35% depending on the TALEN-pair) were observed.

An embodiment of the invention is a composition and a method for using TALENs to genetically modify livestock such as artiodactyls or zebrafish, dogs, mice, rats, fish, avian, chicken, or a laboratory animal. Many of the problems making these animals using conventional processes have been discussed above. The genetic modification may be, for example, chosen from the list consisting of an insertion, a deletion, insertion of or change to an exogenous nucleic acid fragment, an inversion, a translocation, interspecies allele migration, intraspecies allele migration, and gene conversion to a natural, synthetic, or a novel allele. For instance, an undesired mutation in a chromosome or chromosome pair may be replaced with a normal sequence. In general, a target DNA site is identified and a TALEN-pair is created that will specifically bind to the site. The TALEN is delivered to the cell or embryo, e.g., as a protein, mRNA or by a vector that encodes the TALEN. The TALEN cleaves the DNA to make a double-strand break that is then repaired, often resulting in the creation of an indel, or incorporating sequences or polymorphisms contained in an accompanying exogenous nucleic acid that is either inserted or serves as a template for repair of the break with a modified sequence. An exogenous sequence refers to a sequence used to change the target cell, regardless of whether the sequence is actually a nucleic acid inserted into chromosomal DNA or if the sequence is used as a template to change the cellular DNA. The term nucleic acid fragment is broad and includes a chromosome, expression cassette, gene, DNA, RNA, mRNA, or portion thereof. The term ssDNA includes ss-oligonucleotides. The cell or embryo may be, for instance, chosen from the group consisting of livestock, an artiodactyl, a cow, a swine, a sheep, a goat, a bird, a chicken, a rabbit, and a fish. One embodiment is directed to a composition or a method of making a genetically modified livestock and/or artiodactyl or a zebrafish, dogs, mice, bird, fish, avian, chicken, rats or a laboratory animal comprising introducing a TALEN-pair into livestock and/or an artiodactyl cell or an embryo that makes a genetic modification to DNA of the cell or embryo at a site that is specifically bound by the TALEN-pair, and producing the livestock animal/artiodactyl/other animal from the cell. Direct injection may be used for the cell or embryo, e.g., into a zygote, blastocyst, or embryo. Alternatively, the TALEN and/or other factors may be introduced into a cell using any of many known techniques for introduction of proteins, RNA, mRNA, DNA, or vectors. Genetically modified animals may be made from the embryos or cells according to known processes, e.g., implantation of the embryo into a gestational host, or various cloning methods. The phrase "a genetic modification to DNA of the cell at a site that is specifically bound by the TALEN", or "at a targeted chromosomal site", or the like, means that the genetic modification is made at the site cut by the nuclease on the TALEN when the TALEN is specifically bound to its target site. The nuclease does not cut exactly where the TALEN-pair binds, but rather at a defined site between the two binding sites.

Another such embodiment involves a composition or a treatment of a cell that is used for cloning the animal. The cell may be of a livestock and/or artiodactyl cell, fish, zebrafish, dog, mice, rat, laboratory animal, bird, fish, chicken, a cultured cell, an immortalized cell, a primary cell, a primary somatic cell, a zygote, a germ cell, a primordial germ cell, a blastocyst, or a stem cell. For example, an embodiment is a composition or a method of creating a genetic modification comprising exposing a plurality of primary cells in a culture to TALEN proteins or a nucleic acid encoding a TALEN or TALENs. The TALENs may be introduced as proteins or as nucleic acid fragments, e.g., encoded by mRNA or a DNA sequence in a vector.

Genetic modification of animals may also include transfection with a reporter. As discussed above, primary cells were observed to be unstable as a result of cellular modifications mediated by the TALENs and/or TALENs introduction. As a result, success in the modification of primary cells (among other cell types), and/or the creation of new lines of livestock from such cells is not reasonably expected using conventional means. It is theorized, without being bound to a specific theory that cells that express a gene cassette from a first vector are also likely to be successfully modified by a TALEN delivered independently by mRNA or another vector. Expression of a reporter at the embryo/cell-level modification stage allows for elimination of cells that do not express the reporter. Alternatively, it allows for moving cells that express the reporter from the culture for use in animals by cloning or other transgenic animal techniques, or into a second culture for further cultivation and/or expansion in number and/or addition of further vectors and/or nucleic acids and/or TALENs and/or other genetic modifications. Selecting cells based on their expression of a reporter that is independent of the gene of interest is a type of co-selection process.

The term reporter, as used herein, refers to genes or transgenes that encode reporters and selection markers. The term selection marker, as used herein, refers to a genetically expressed biomolecule that confers a trait that permits isolation by either positive or negative survival selection criteria. The reporter may be, e.g., a fluorescent marker, e.g., green fluorescent protein and yellow fluorescent protein. The reporter may be a selection marker, e.g., puromycin, ganciclovir, adenosine deaminase (ADA), aminoglycoside phosphotransferase (neo, G418, APH), dihydrofolate reductase (DHFR), hygromycin-B-phosphtransferase, thymidine kinase (TK), or xanthin-guanine phosphoribosyltransferase (XGPRT). Phenotypic markers are markers based on discernible physical traits (e.g., epitopes or color), growth rate, and/or viability.

The term selection marker, as used herein, refers to a genetically expressed biomolecule that confers a trait that permits isolation by either positive or negative survival selection criteria. The reporter may be, e.g., a florescent marker, e.g., green fluorescent protein and yellow fluorescent protein. The reporter may be a selection marker, e.g., puromycin, ganciclovir, adenosine deaminase (ADA), aminoglycoside phosphotransferase (neo, G418, APH), dihydrofolate reductase (DHFR), hygromycin-B-phosphtransferase, thymidine kinase (TK), or xanthin-guanine phosphoribosyltransferase (XGPRT). For instance, a selection marker may allow a cell to survive in the presence of a small molecule, thereby enabling selection. Other phenotypic markers may be used to select animals, such markers are based on discernible physical traits (e.g., epitopes or color), growth rate, and/or viability.

Embodiments of the invention include introducing a reporter (for instance by use of a vector) and a TALEN (e.g., by an independent vector or mRNA) into a cell or embryo. The cell may be from a livestock and/or artiodactyl, bovine, avian, chicken, zebrafish, dog, mice, rats or a laboratory animal. The TALEN and/or reporter may be directly introduced, e.g., by injection, or other means, e.g., involving cell culture. A cell culture may be made comprising cultured cells (primary cells, zygotes, oocytes, immortalized cells, germ cells, primordial germ cells, stem cells), a first nucleic acid encoding a TALEN, e.g., mRNA or a vector with DNA encoding the TALEN, and an independent vector having a DNA sequence encoding a reporter. The mRNA or first vector do not encode any reporters and the second vector does not encode any TALs and does not encode any TALENs.

Vectors for the reporter, selection marker, and/or one or more TALEN may be a plasmid, transposon, transposase, viral, or other vectors, e.g., as detailed herein. Transposases may be used. One embodiment involving a transposases provides a vector that encodes a transposase. Other vectors encode a transposon that is recognized by the transposase and has a nucleic acid fragment of interest, e.g., a reporter, selection marker, exogenous nucleic acid for insertion or as a template for modification, or one or more TALENs. Accordingly, a cell or embryo may be transfected with a number of vectors between, for example, 1 and about 6; artisans will immediately appreciate that all the ranges and values within the explicitly stated ranges are contemplated, e.g., 2, 3, 4, 5, and 6. More vectors may be used. The reporter may be used to identify cells that are likely to have undergone modification by TALENs. Or a selection marker may be used to enrich the proportion of TALEN-modified cells by destroying cells or embryos that do not express the selection marker.

An embodiment of the invention is a cell or embryo culture exposed to, or injected with, a plurality of vectors. A first vector comprises a TALEN or TALEN-pair; alternatively there are two TALEN vectors that independently provide a left TALEN and a right TALEN. A second vector comprises a reporter. The reporter may provide for non-destructive identification or may be a selection marker. A vector encoding a selection marker may be used as an alternative to the reporter vector, or in addition to the reporter vector. A further vector may encode an exogenous nucleic acid.

A process for making TALEN-modified cells, embryos, or animals can comprise assaying a cell or embryo exposed to a TALEN for expression of a reporter and using that cell or embryo in a method or composition for making a genetically modified livestock and/or artiodactyl or other animal (fish, zebrafish, dogs, mice, avian, chicken, rats or a laboratory animal). For instance, a primary cell may be removed from a cell culture and used for cloning. Or, a primary cell may be removed from culture and placed in a second culture to make a clonal line or for further processes. Or, an embryo or zygote expressing the reporter may be used for either implantation into a surrogate dam or can be used for cloning, while other embryos or zygotes that do not express the reporter not used for cloning. In some embodiments, the reporter is a selection marker that is used to select for cells or embryos that express the marker.

Allele Introgression in Pig, Goat and Cattle Genomes

Figure 37A:
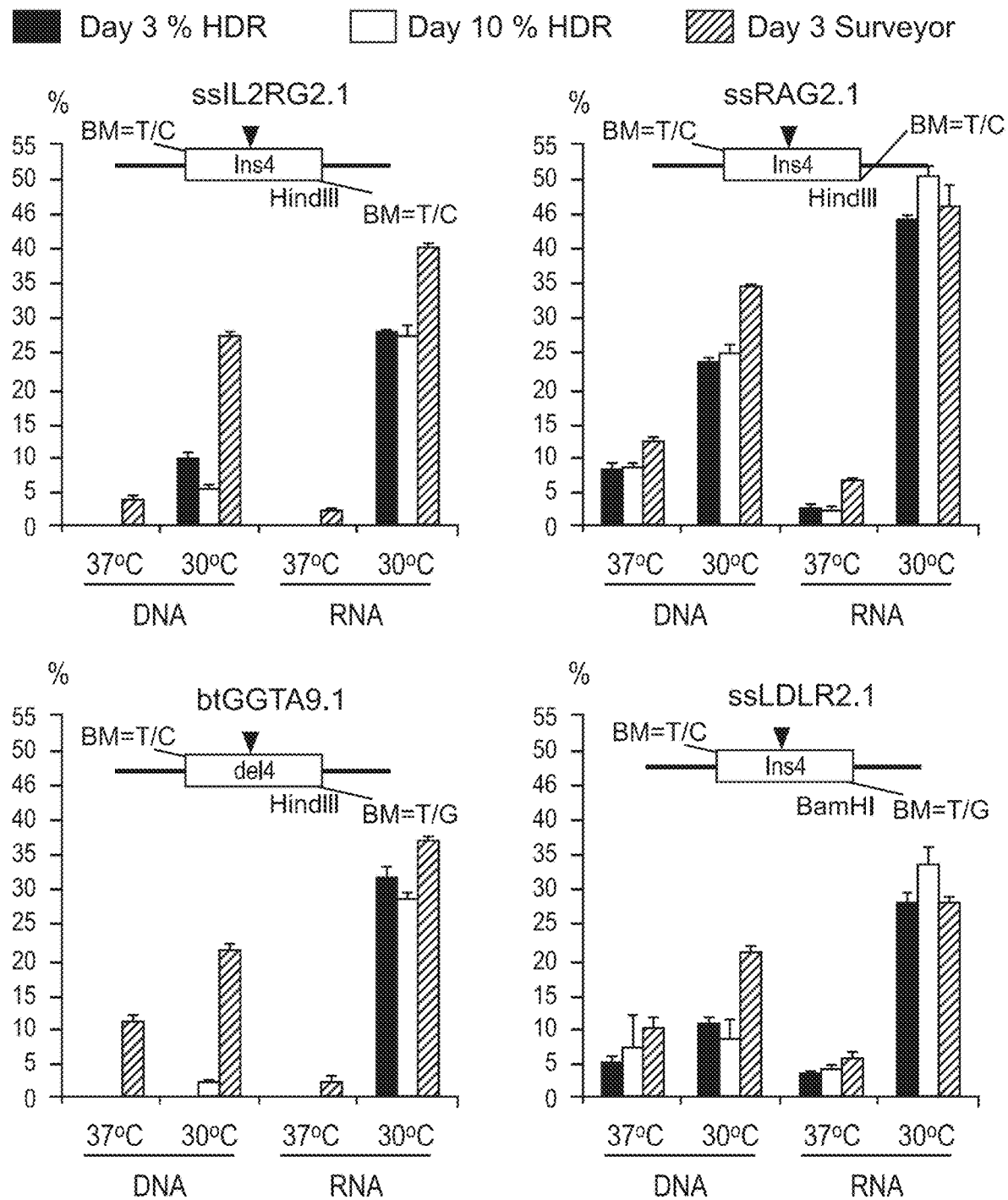
FIG. 37A: A plot showing that an mRNA source of TALENs stimulated efficient and consistent HDR using an oligo donor. Each chart displays results of targeting a specific locus in fibroblasts (e.g., ssIL2RG; "ss" for *Sus scrofa* and "bt" for *Bos taurus*) using oligo donor templates and TALENs delivered as plasmid DNA or mRNA. (Insets) Diagrams of the oligo templates, in which the shaded boxes represent the TALEN-binding site and the spacers are shown in white. Each oligo contains either a 4-bp insertion (ins4) or deletion (del4) that introduces a novel restriction site for RFLP analysis. Presumptive BMs replace the conserved −1 thymidine (relative to the TALEN-binding site) with the indicated nucleotide. Fibroblasts were transfected with either TALEN-encoding plasmids (3 μg) or mRNA (1 μg) along with 3 μM of their cognate oligo-homologous template. Cells were then incubated at 37° C. or 30° C. for 3 d before expansion at 37° C. until day 10. TALEN activity was measured by the Surveyor assay at day 3 (Day3 Surveyor), and HDR was measured at days 3 and 10 by RFLP analysis (Day3% HDR and Day10% HDR). Each bar displays the average and SEM from three replicates.

While plasmid templates were effective for introgression of POLLED and GDF8, the inventors believe that many desirable alleles correspond to SNPs. A set of experiments used oligonucleotide templates that had an overlap in their cognate TALEN-binding sites and that also introduced a 4 bp indel into the spacer region for restriction fragment length polymorphism (RFLP) analysis. Primary fibroblasts were transfected with plasmid- or mRNA-encoded TALENs plus oligo templates and incubated 3 days at either 30 or 37° C. TALENs delivered as mRNA consistently outperformed plasmid in cells incubated at 30° C. (FIG. 37A). Despite appreciable levels of TALEN activity measured by the SURVEYOR assay, HDR was consistently higher (>2-fold) when TALENs were delivered as mRNA compared to plasmids. This observation was surprising, and it was speculated that could have been a result of favorable kinetics; e.g., TALENs from mRNA were more rapidly translated allowing utilization of the template prior to oligo degradation. However, a time-course experiment showed little difference in the onset of HDR between TALENs encoded by plasmid versus mRNA (FIG. 37B). Among replicates using TALEN mRNA at 30° C., the levels of cumulative mutation and total HDR were similar, suggesting the majority of mutant alleles corresponded to the intended introgression.

In some studies, TALEN-induced indels declined 50-90% after extended culture where selection processes or markers were not used (Carlson, D. F. et al. Efficient TALEN-mediated gene knockout in livestock, Proceedings of the National Academy of Sciences, 109:17382-17387 (2012), herein "Carlson 2012"). In other words, in some instances, when indels were made, they were often not stable and a selection marker process was used to identify stable changes. In contrast, it was observed herein that HDR levels at four loci were roughly equivalent when measured at days 3 and 10 without selective enrichment, indicating that these HDR indel alleles were stable in culture (FIG. 37A). The consistently high rate (25-50%) and stability of gene edits at all four loci suggested that edited cells should be recoverable by dilution cloning without selective enrichment, reporters or selection markers. Further experimental work involving analysis of about 1,000 colonies for defined indel alleles in eight separate loci revealed a recovery rate of 10-65% (average 42%) where up to 32% of the colonies are homozygous for the intended edit (Table 7). The data shows that introducing TALENs as mRNA into the cell is helpful for efficiency and stability; extended culture times at 30° C. were also helpful.

Production of Biomedical Model Animals with Gene-Edited Alleles

Two gene-edited loci in the porcine genome were selected to carry through to live animals—APC and DAZL. Mutations in the adenomatous polyposis coli (APC) gene are not only responsible for familial adenomatous polyposis (FAP), but also play a rate-limiting role in a majority of sporadic colorectal cancers. Dazl (deleted in azoospermia-like) is an RNA binding protein that is important for germ cell differentiation in vertebrates. The DAZL gene is connected to fertility, and is useful for infertility models as well as spermatogenesis arrest. Colonies with HDR-edited alleles of DAZL or APC for were pooled for cloning by chromatin transfer. Each pool yielded two pregnancies from three transfers, of which one pregnancy each was carried to term.

A total of eight piglets were born from DAZL modified cells, each of which reflected genotypes of the chosen colonies consistent with either the HDR allele or deletions resulting from NHEJ. Three of the DAZL piglets were stillborn. Of the six piglets from APC modified cells, one was stillborn, three died within one week, and another died after 3 weeks, all for unknown reasons likely related to cloning. All six APC piglets were heterozygous for the intended HDR-edited allele and all but one either had an in-frame insertion or deletion of 3 bp on the second allele. Remaining animals are being raised for phenotypic analyses of spermatogenesis arrest (DAZL−/− founders) or development of colon cancer (APC+/− founders).

Template-driven introgression methods are detailed herein. Embodiments of the invention include template-driven introgression, e.g., by HDR templates, to place an APC or a DAZL allele into a non-human animal, or a cell of any species.

This method, and methods generally herein, refer to cells and animals. These may be chosen from the group consisting of vertebrate, livestock, an artiodactyl, a primate, cattle, a swine, a sheep, a goat, a bird, a chicken, a rabbit, fish, dog, mice, rat, cat or laboratory animal. The term livestock means domesticated animals that are raised as commodities for food or biological material. The term artiodactyl means a hoofed mammal of the order Artiodactyla, which includes cattle, deer, camels, hippopotamuses, sheep, pigs and goats that have an even number of toes, usually two or sometimes four, on each foot.

Alleles for Introgression

Allele introgression has many important applications. The Allelic Introgression Table, below, and Table 7 (Frequencies for recovery of colonies with HDR alelles) describe certain genes and their applications. Artisans reading this application will be able to make and use the introgressions and resultant cells and animals. Artisans can readily apply the processes set forth herein for the use of these alleles as templates or targets for disruption. Embodiments include making a genetically modified cell or animal (for instance, a lab animal, an F0 founder, or animal line) whose genome has received a gene from Table 7 or the Allelic introgression Table, e.g., by insertion or template-driven allele introgression that replaces the endogenous allele with an allele from Table 7 or the Allelic introgression Table. Alleles for some genes are reported to provide livestock production advantages, but are at very low frequencies or are absent in some breeds or species (see items 1-9). Introgression of these alleles can be of significant value for production traits. For example, the Polled allele (item 1) from beef breeds results in animals that do not have horns, whereas dairy breeds do not have this allele so have horns and need to be dehorned as a production practice. Allele introgression from beef breeds into horned (dairy) breeds will lead to hornless dairy cattle which is has value for both production and animal welfare. Other examples relate to alleles that can increase or enhance characteristics of agricultural products such as meat (items 4-6) and milk (items 7-8). Item 9 is useful for disease resistance.

Many commercial and commonly used animal breeds have been carefully bred to establish desirable traits but, in the process of that breeding, have accumulated genetic errors that reduce their reproductive success because of losses in fertility or by increasing miscarriages. Deleterious alleles for some genes are present in animal populations. As explained elsewhere herein, the inventive techniques provide for changing alleles only at an intended location in a target animal, without other modifications resulting from genetic tools or from meiotic recombinations. Therefore, for the first time, it is possible to clean-up the genetic errors that have accumulated in livestock and animal breeds without disrupting the genome of the animals and, consequently, disrupting traits or causing unintended consequences. Alleles for some genes can be used to control animal fertility for genetic control of breeding stock (items 2-3). The term breed is a term of art that refers to domestic animals that, through selection and breeding, have come to resemble one another and pass those traits uniformly to their offspring. The animals that belong to a particular breed are known to artisans that practice in these arts. Breed specific characteristics, also known as breed traits, are inherited, and purebred animals pass such traits from generation to generation. Thus, all specimens of the same breed carry several genetic characteristics of the original foundation animal(s). In order to maintain the breed, a breeder would select those animals with the most desirable traits to achieve further maintenance and developing of such traits. At the same time, the breed would avoid animals carrying characteristics undesirable or not typical for the breed, including faults or genetic defects. In our examples, we recruit genetic benefits (specific traits) from one breed into another without the traits that are considered negative in a certain breed.

Many useful animal models can be made. Certain alleles are useful, see Allelic introgression Table items 10-39. Some of these are established in animals. Others of the genes are known to cause human disease, so introgressing these alleles into livestock, lab animals, or other animals is useful to create biomedical models of human disease.

Embodiments of the invention include a method of making a genetically modified animal, said method comprising exposing embryos or cells to an mRNA encoding a TALEN, with the TALEN specifically binding to a target chromosomal site in the embryos or cells, cloning the cells in a surrogate mother or implanting the embryos in a surrogate mother, with the surrogate mother thereby gestating an animal that is genetically modified without a reporter gene and only at the TALEN targeted chromosomal site wherein the allele is a member of the group consisting of (a) horn polled locus (b) a gene recessive for fertility defects, e.g., CWC15 and/or ApaF1 (c) genes for enhancing a livestock trait, e.g., meat production (GDF8, IGF2, SOCS2, or a combination thereof) and/or milk production (DGAT1 and/or ABCG2) (d) a gene for changing animal size (PLAG1, GHRHR) (e) genes that potential tumor growth (e.g., TP53, APC, PTEN, RB1, Smad4, BUB1B, BRCA1, BRCA2, ST14 or a combination thereof) (f) human oncogenes for animal models of cancer (e.g., AKT1, EGF, EGFR, KRAS, PDGFRA/B or a combination thereof) (g) genes in animal models for hypercholesterolemia (to induce atherosclerosis, stroke, and Alzheimer's disease models), e.g., LDLR, ApoE, ApoB or a combination thereof (h) Inflammatory Bowel disease, e.g., NOD2 (i) spina bifida, e.g., VANGL1 and/or VANGL2 (j) pulmonary hypertension, e.g., miR-145 (k) genes for cardiac defects, e.g., BMP10, SOS1, PTPN11, Nrg1, Kir6.2, GATA4, Hand2, or a combination thereof and (1) celiac disease genes, e.g., HLA-DQA1.

| | Allelic Introgression Table | |
|---|---|---|
| Item | Genes; Species [Gene Reference Identification] | Application |
| 1 | Horn-Polled Locus; Bovine [UMD3.1:1:1705490:1706389:1] | Transfer allele into cows of various breeds to make bovine lines of those species without horns; see Medugorac, I., D. Seichter, et al., (2012). "Bovine polledness - an autosomal dominant trait with allelic heterogeneity." PloS one, 7(6):e39477. |
| 2 | CWC15 (JH1) [hs Gene ID: 51503] | Use natural allele as template to restore wildtype sequence to animal lines and breeds with defective alleles; see VanRaden, P. M., K. M. Olson, et al., (2011). "Harmful recessive effects on fertility detected by absence of homozygous haplotypes." J Dairy Sci., 94(12):6153-6161. |
| 3 | ApaF1 (HH1) [hs Gene ID: 317] | |
| 4 | GDF8 [hs Gene ID: 2660] | Enhancement of growth for meat production. |
| 5 | IGF2 [hs Gene ID: 3481] | |
| 6 | SOCS2 [hs Gene ID: 8835] | |
| 7 | DGAT1 [hs Gene ID: 8694] | Alleles of these genes are known to influence the amount and composition of milk. |
| 8 | ABCG2 Hs Gene ID: 9429] | |
| 9 | GHRHR [hs Gene ID: 2692] | Size reduction of animals for Biomedical modeling. |
| 10 | TP53 [hs Gene ID: 7157] | Tumor suppressor genes; heterozygous knockout to potentiate tumor growth. |
| 11 | APC [hs Gene ID: 324] | |
| 12 | PTEN [hs Gene ID: 5728] | |
| 13 | RB1 [hs Gene ID: 5925] | |
| 14 | Smad4 [hs Gene Id: 4089] | |
| 15 | BUB1B [hs Gene ID: 701] | |
| 16 | BRCA1 [hs Gene ID: 672] | |
| 17 | BRCA2 [hs Gene ID: 675] | |
| 18 | ST14 [hs Gene ID: 6768] | |
| 19 | AKT1 [hs Gene ID: 207] | Oncogenes. Activated human alleles will be introgressed into pigs to model cancers. |
| 20 | EGF [hs Gene ID: 1950] | |
| 21 | EGFR [hs Gene ID: 1956] | |
| 22 | KRAS [hs Gene ID: 3845] | |
| 23 | PDGFRA/B [hs Gene IDs: 5156/5159] | |
| 24 | LDLR [hs Gene ID: 3949] | Hypercholesterolemia to induce atherosclerosis, stroke and Alzheimer's disease models. |
| 25 | ApoE [hs Gene ID: 348] | |
| 26 | ApoB [hs Gene ID: 338] | |
| 27 | NOD2 [hs Gene ID: 641271] | Inflammatory Bowel disease for animal models. |
| 28 | VANGL1 [hs Gene ID: 81839] | Spina Bifida is associated with alleles of these genes. Transfer of these alleles in livestock will generate models for biomedical research. |
| 29 | VANGL2 [hs Gene ID: 57216] | |
| 30 | miR-145 [hs Gene ID: 611795] | Pulmonary hypertension is associated with alleles of these genes. Transfer of these alleles in swine will generate models for biomedical research. |
| 31 | BMP10 [hs Gene ID: 27302] | Cardiac defects associated with alleles of these genes. Transfer of these alleles will generate models for biomedical research. |
| 32 | SOS1 [hs Gene ID: 6654] | |
| 33 | PTPN11 [hs Gene ID: 5781] | |
| 34 | Nrg1 [hs Gene ID: 3084] | |
| 35 | Kir6.2 [hs Gene ID: 3767] | |

Allelic Introgression Table

| Item | Genes; Species [Gene Reference Identification] | Application |
|---|---|---|
| 36 | GATA4 [hs Gene ID: 2626] | |
| 37 | Hand2 [hs Gene ID: 9464] | |
| 38 | HLA-DQA1 [hs Gene ID: 3117] | Alleles associated with celiac disease will be transferred to livestock to create an animal model. |

Differential Stability of Gene-Edits

Figure 38:
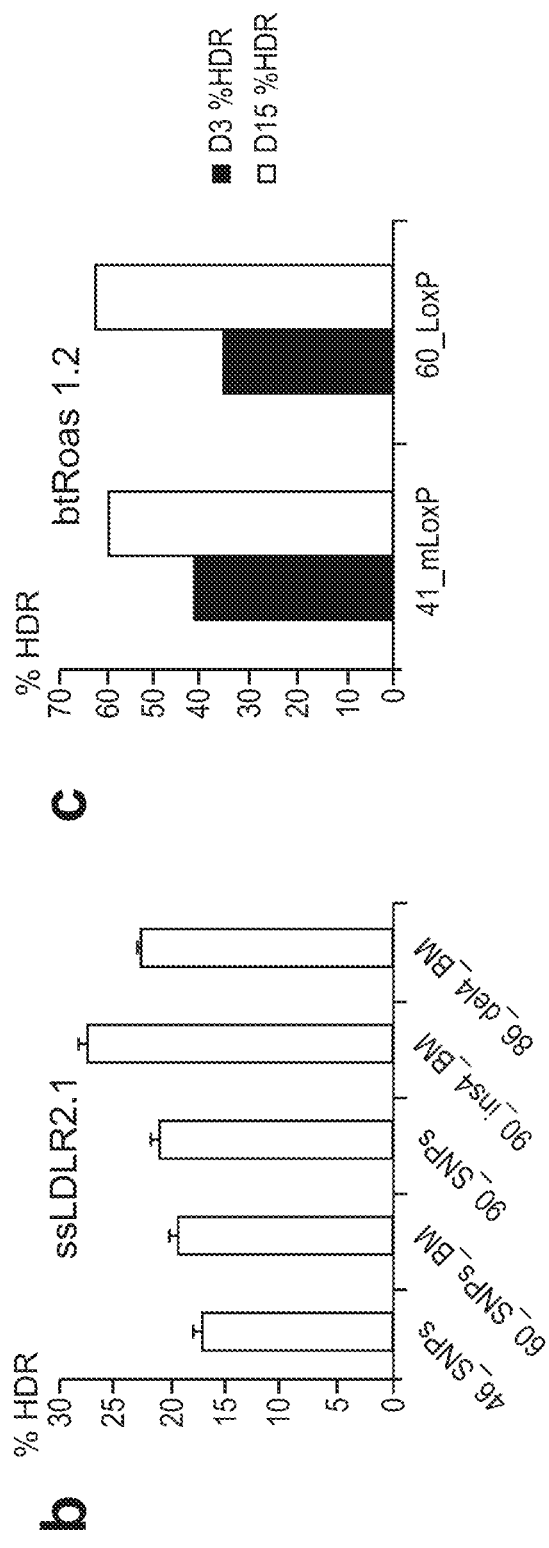
FIG. 38: A plot of experimental data generated to evaluate influence of mutation type on the frequency of HDR. Panel a) The wildtype ssLDR (SEQ ID NO:241) and sequence of five oligos used to target ssLDLR: (from top to bottom: SEQ ID NOS: 242, 243, 244, 245, and 246). TALEN binding sites are indicated in boxed text and the novel BamHI site is underlined. SNPs including BMs and insertions are circled. Panel b) Cells were transfected with LDLR2.1 TALEN mRNA (1 μg) and oligos (2 μM final). HDR at day 3 was determined by RFLP analysis and the average with SEM (n=3) was plotted. Panel c) Cattle cells were transfected with btRosa1.2 TALEN mRNA and either 41 mloxP or 60 loxP oligos (2 μM final). The numbers 41 and 60 refer to the number of homologous bases. Each oligo contains a 34 bp loxP site, either a modified (mloxP) or wild type (loxP) version, in the center of the spacer.
Figure 39:
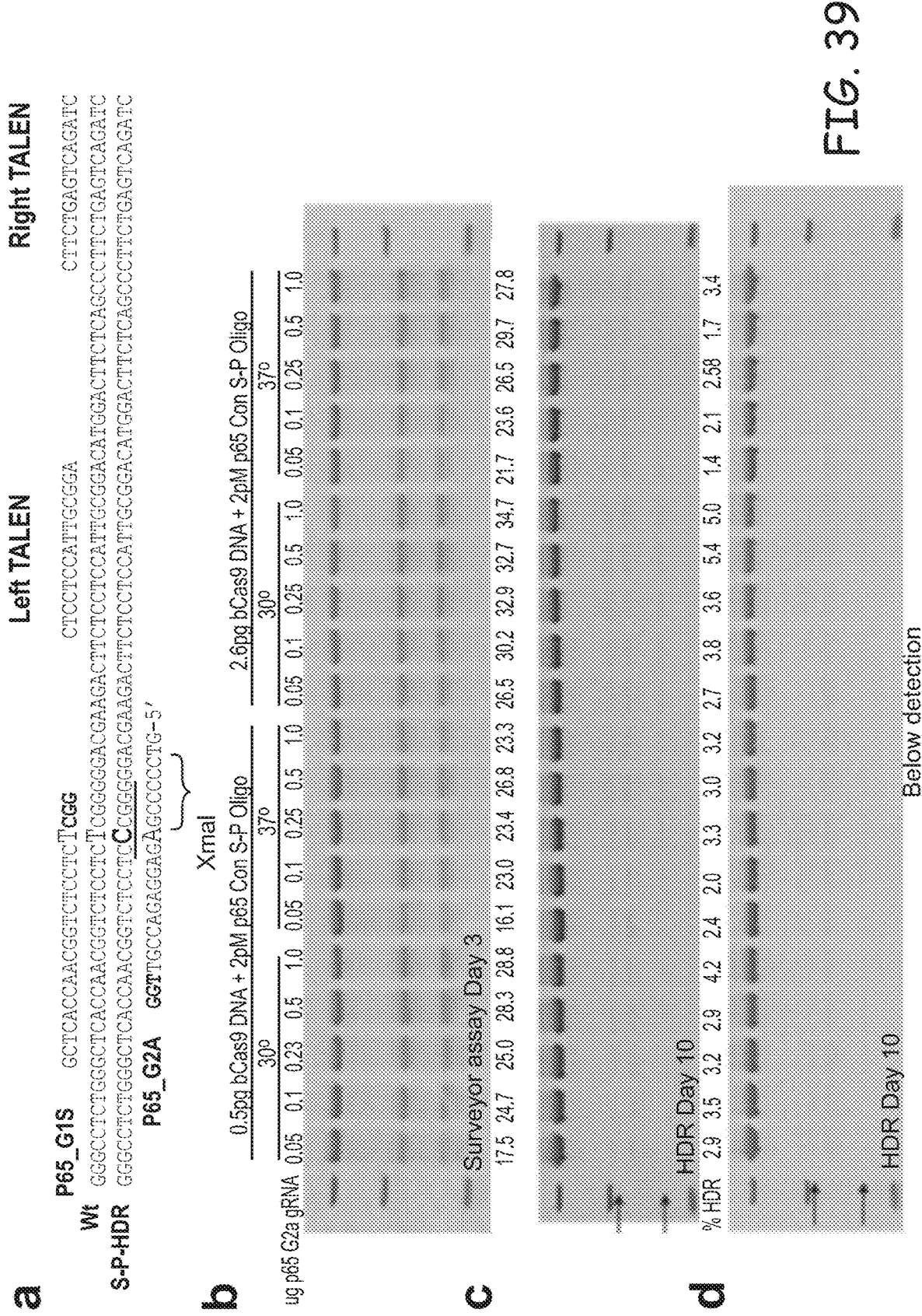
FIG. 39: CRISPR/Cas9 mediated HDR to introgress the p65 S531P mutation from warthogs into conventional swine. Panel a) The S531P missense mutation is caused by a T-C transition at nucleotide 1591 of porcine p65. The S-P HDR template includes the causative TC transition mutation (oversized text) which introduces a novel XmaI site and enables RFLP screening. Panel b) Cells were transfected with S—P-HDR oligos (2 μM), two quantities of plasmid encoding hCas9 (0.5 μg or 2.0 μg); and five quantities of the G2A transcription plasmid (0.05 to 1.0 μg). Cells from each transfection were split 60:40 for culture at 30 and 37° C. respectively for 3 days before prolonged culture at 37° C. until day 10. Surveyor assay revealed activity ranging from 16-30%. Panels c and d) RFLP analysis of cells sampled at days 3 and 10. Expected cleavage products of 191 and 118 bp are indicated by black arrows. The two gRNA sequences are P65_G1S (SEQ ID NO:247) and P65_G2A (SEQ ID NO:248). The wild type porcine p65 is SEQ ID NO:249, shown in alignment with the homology directed repair (HDR) template S—P-HDR (SEQ ID NO:250). The left TALEN sequence and right TALEN sequence to bind p65 DNA are SEQ ID NOs: 251 and 252, respectively.
Figure 40:
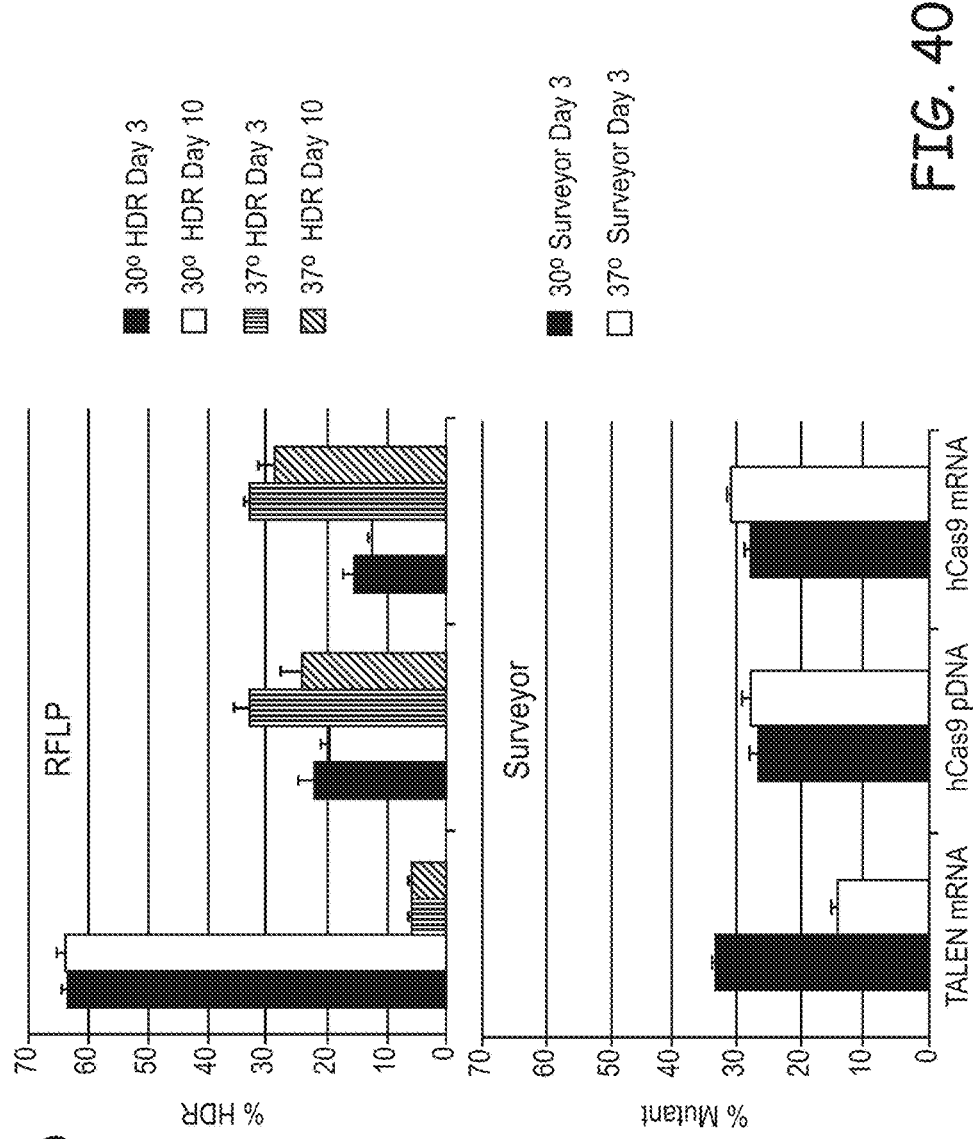
FIG. 40: Experimental data for comparison of TALENs and CRISPR/Cas9 mediated HDR. Panel a) APC14.2 TALENs (SEQ ID NOS:253 and 254) and the gRNA sequence APC14.2 G1a (SEQ ID NO:255) are shown relative to the wild type APC sequence (SEQ ID NO:256). Below, the HDR oligo (SEQ ID NO:257) is shown which delivers a 4 bp insertion (boxed text) resulting in a novel HindIII site. Cells were transfected with HDR template, and TALEN mRNA, plasmid DNA encoding hCas9 and the gRNA expression plasmid; or mRNA encoding hCas9 plus the gRNA expression plasmid, cultured at either 30 or 37° C. for 3 days before expansion at 37° C. until day 10. Panel b) Charts displaying RFLP and Surveyor assay results

It was not known if it was possible to have introgression of stable SNPs by NHEJ or HDR. As indicated in Table 7, both day-3 levels of HDR (7-18%) and the isolation of cellular clones with the intended SNP alleles (3-15%) within cattle and swine GDF8 or pig p65 was significantly lower than for indel alleles, where HDR ranged from 10 to about 50%. This data suggested a hypothesis that indels were more stable than SNP because the introduction or elimination of at least 4 bp in the TALEN spacer region would be expected to reduce re-cleavage of the locus, consistent with constraints on TALEN spacer length. And even a 4 bp insertion allele was more efficient than SNP alleles, based comparison of HDR frequencies with oligo within the same locus suggested (FIG. 38). This hypothesis also explained why sequence analysis revealed that nearly half of the isolated SNP-positive colonies for GDF8 or pig p65 harbored concomitant indels expected to change TALEN spacing. Regardless, it was possible to recover colonies with homozygous conversion of G938A in GDF8 (both pigs and cattle) and T1591C in pig p65 at up to nearly a 5 percent level without any additional changes to the locus (Table 7). It was also possible to introgress small polymorphisms for the sheep FecB and Callipyge loci into the goat genome. This ability to precisely alter a single nucleotide or 1-3 nucleotides is surprising as well as significant. As a comparison, it was also possible to design CRISPR gRNAs that overlapped the T1591C site of p65 and to compare introgression using the two platforms. Despite efficient production of DSB at the intended site, CRISPR/Cas9-mediated HDR was lower than 6 percent at day-3 and below detection at day-10 (FIG. 39). Recovery of modified clones with CRISPR-mediated HDR was also lower than with TALENs even though the TALENcleavage site was 35 bp away from the SNP site (Table 7). Analysis of CRISPR/Cas9 induced targeting at a second locus, ssAPC14.2, was much more efficient, but still did not reach the level of HDR induced by TALENs at this site, circa 30 versus 60% (FIG. 40).

Figure 41:
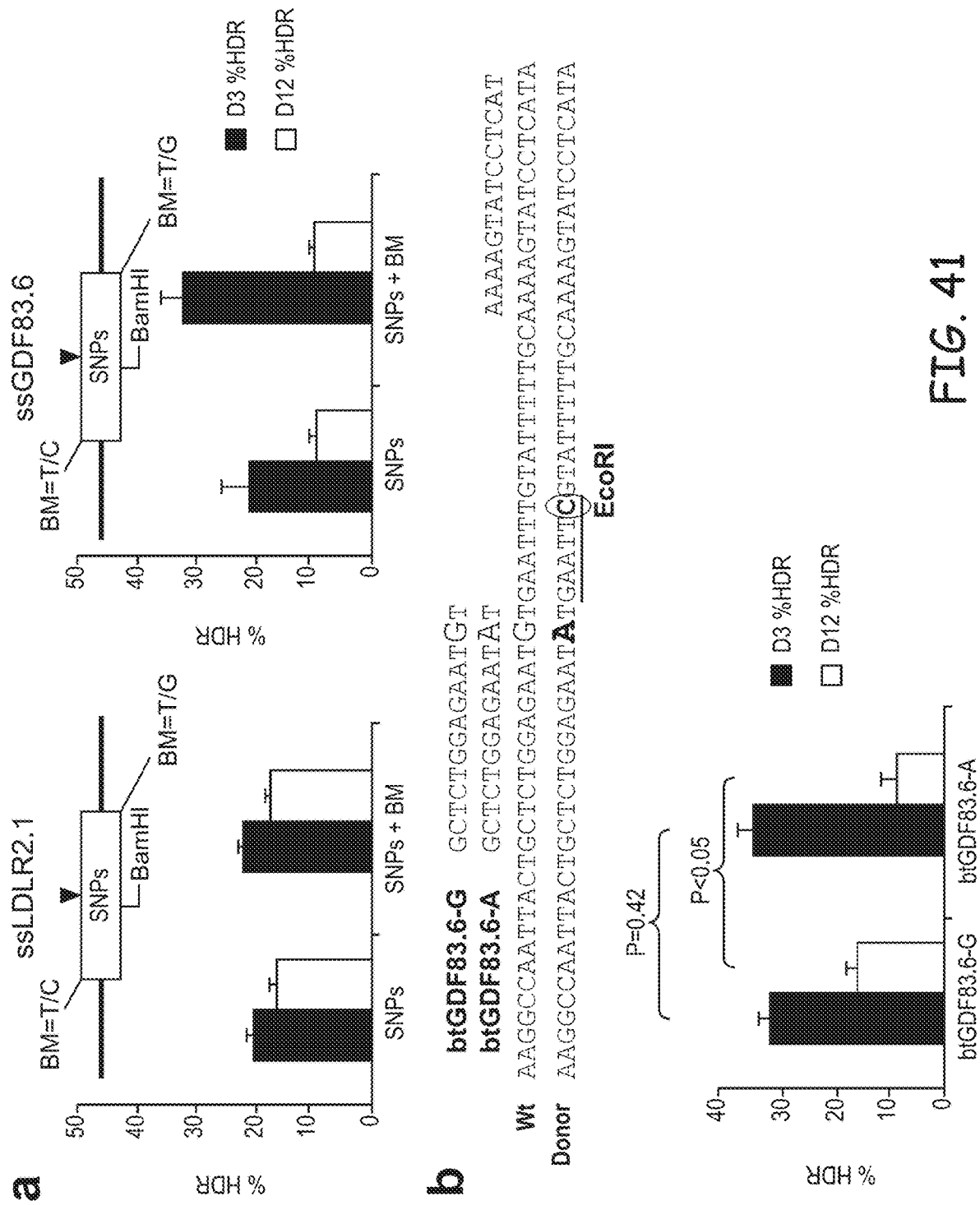
FIG. 41: Experimental data for SNP introgression using oligo donors. Panel a) is a plot of maintenance of HDR alleles with or without blocking mutations (BMs) for pig LDLR and GDF8. Each oligo had the same SNPs/restriction 313 site plus or minus BMs. Average homologous recombination and SEM (n=3) is shown. Panel b) shows results for introgression of myostatin C313Y into Wagyu fibroblasts. The C313Y missense mutation is caused by a G-A transition (indicated by oversized text) at nucleotide 938 of *bovine* myostatin. The HDR template (labeled donor, SEQ ID NO:258), also includes a T to C transition (circled) to introduce a novel EcoRI site for RFLP screening. Two left TALENs were designed against the locus, btGDF83.6-G (SEQ ID NO:259), targeting the wild type alelle (Wt) (SEQ ID NO:260), and btGDF83.6-A (SEQ ID NO:261), targeting the mutant allele (C313Y); both share a common right TALEN (SEQ ID NO:262). Transfection, culture and measurement were conducted as above. The average and SEM for btGDF83.6-G (n=30) and btGDF83.6-A (n=5) represent twelve and three biological replicates, respectively. A two-sided student's t-test was used to compare averages between groups; the p values are indicated.

Strategies for Introgression of Alleles and for Stabilizing Introgressed SNP Alleles Given the conservation of the 5'-thymidine nucleotide immediately preceding TAL-binding sites, it was reasoned that altering these bases in the oligo HDR template (referred to as blocking mutations (BM)) would inhibit re-cleavage of edited alleles. Surprisingly, the BMs had no significant impact on the maintenance of SNP alleles at the pig LDLR or GDF8 loci (FIG. 41 panel a). This suggested that either the conversion tract for oligo-templated HDR is quite short and does not incorporate the BM, or that altering the 5'-thymidine does not completely abolish TALEN activity.

Figure 42:
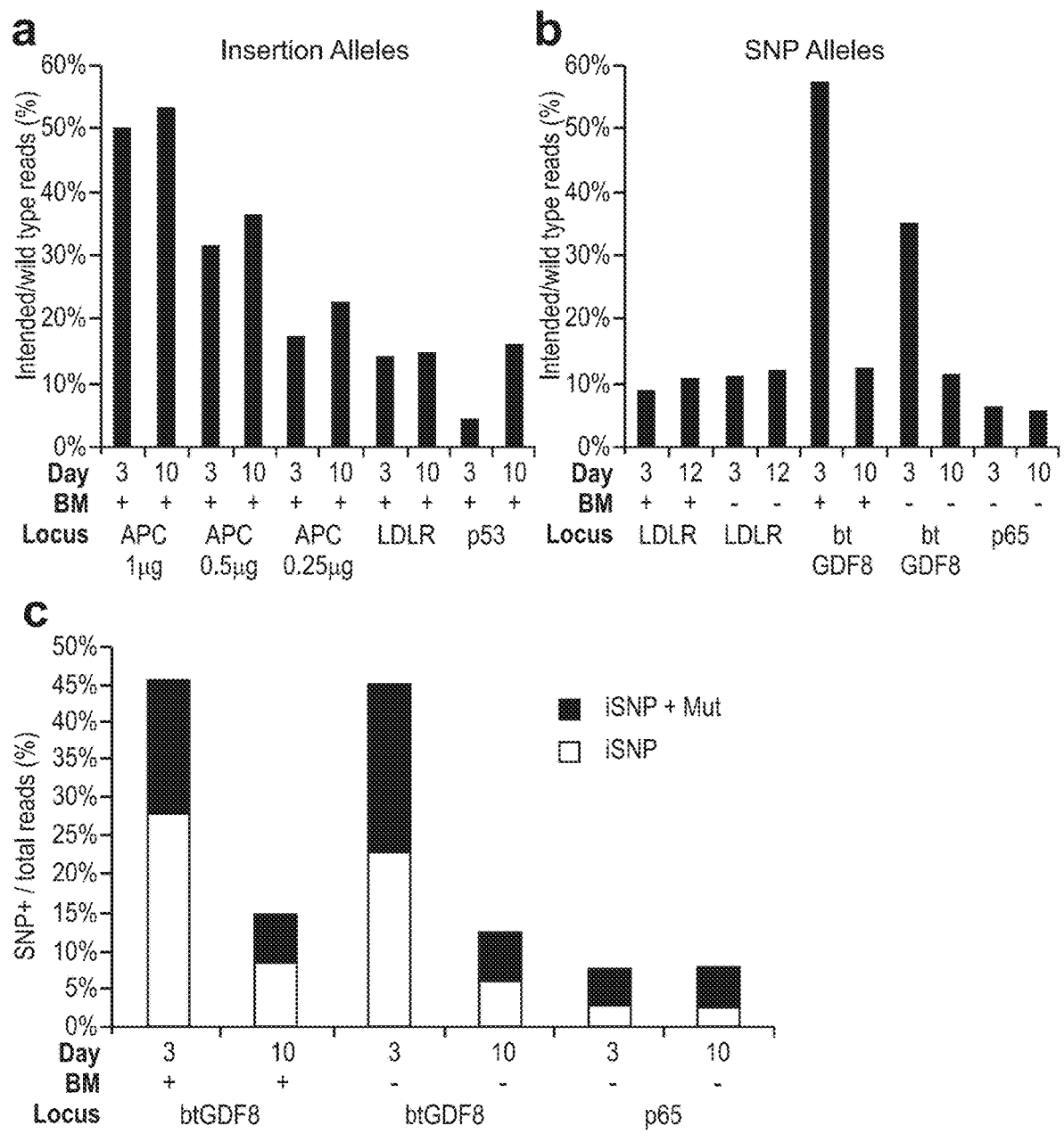
FIG. 42: A plot that shows results for sequence analysis of TALEN stimulated HDR alleles. The count of perfect, intended HR reads versus the wild type reads is plotted for insertion (panel a) and SNP alleles (panel b). The target locus, time point and whether or not BMs were included in the oligo are indicated. Panel c). Reads from btGDF8 and p65 sorted for incorporation of the target SNP and classified as intended (iSNP) versus those with an additional mutation (iSNP+Mut) and plotted against the total number of reads.
Figure 43:
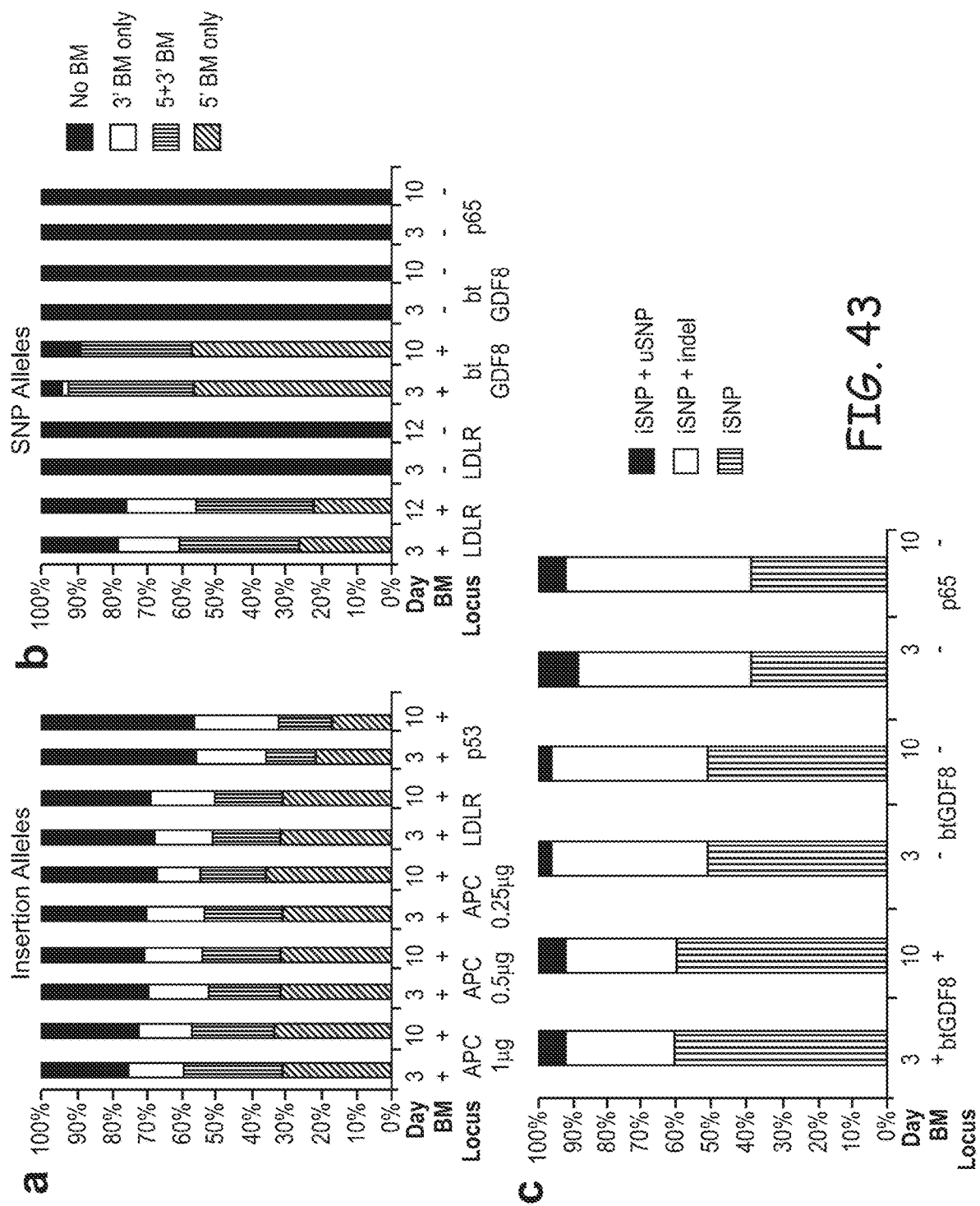
FIG. 43: Results of sequence analysis of HDR alleles. Sequencing reads containing the correct insertion (Panel a) or SNP allele (Panel b) were analyzed for incorporation of BM. The target locus, time point and whether or not BMs were included in the oligo are indicated below each graph. Panel c). The data of FIG. 13 panel c was further classified by mutation type and compared. Some reads contained only the iSNP, others had a concomitant indel (iSNP+indel), or a concomitant unintended SNP (iSNP+uSNP).

ILLUMINA deep sequencing was conducted for 200-250 bp amplicons flanking the target sites from populations of cells transfected with oligos and TALEN mRNA. The results from five loci in pigs and cattle showed that insertion alleles were in general more prevalent and stable in the population (FIG. 42). Whereas BMs had little influence on the preservation of intended alleles in culture, there was a slight bias towards incorporation of BMs in SNP edited alleles versus insertional edits (FIG. 43). with our colony analysis, reads sorted on the basis of incorporating the intended SNP (iSNP), G938A or T1591C conversion in btGDF8 and p65, revealed that nearly half of reads with the iSNP had an additional mutation (iSNP+Mut) (FIG. 42 panel b), the majority of which were indels (FIG. 43). The majority of iSNP btGDF8 reads with indels in the spacer also contained one or both BM (data not shown) demonstrating that modification of the conserved 5'-thymidine was not able to suppress re-cleavage and subsequent indel generation. Thus, this base must be less critical to TALEN-binding than suggested by conservation, and provides a molecular basis for the inability of BMs to preserve alleles as described above.

Another strategy to reduce re-cutting of the SNP edits is to design TALENs such that their binding sites overlap the target SNPs. The influence of RVD/nucleotide mismatches within the TALEN-binding site for introgression of G938A SNP into cattle GDF8 was evaluated. Two pairs of TALENs were generated, one that bound the wildtype "G" allele (btGDF83.6-G) and another that bound the intended "A" allele (btGDF83.6-A) (FIG. 41 panel b). HDR with each TALEN pair was similar at day-3 whereas levels measured at day-12 were significantly higher using the TALENs that bound the wildtype "G" allele, indicating that recleavage was more prevalent with btGDF83.6-A which targets the repaired allele perfectly. Different RVD/nucleotide mismatches may have greater influence on maintenance of HDR alleles since the NN-RVD used for the wildtype "G" TALENs is able to bind both G and A nucleotides. For modification of porcine EIF4GI, it was found that three RVD/nucleotide mismatches were sufficient for protection of the HDR-edit as nearly 70% of isolated colonies contained an edited allele, greater than half of those being homozygotes (Table 7 and FIG. 44). Thus, the intentional alteration of the target locus to resist recleavage is an effective strategy for preserving edits.

Figure 45:
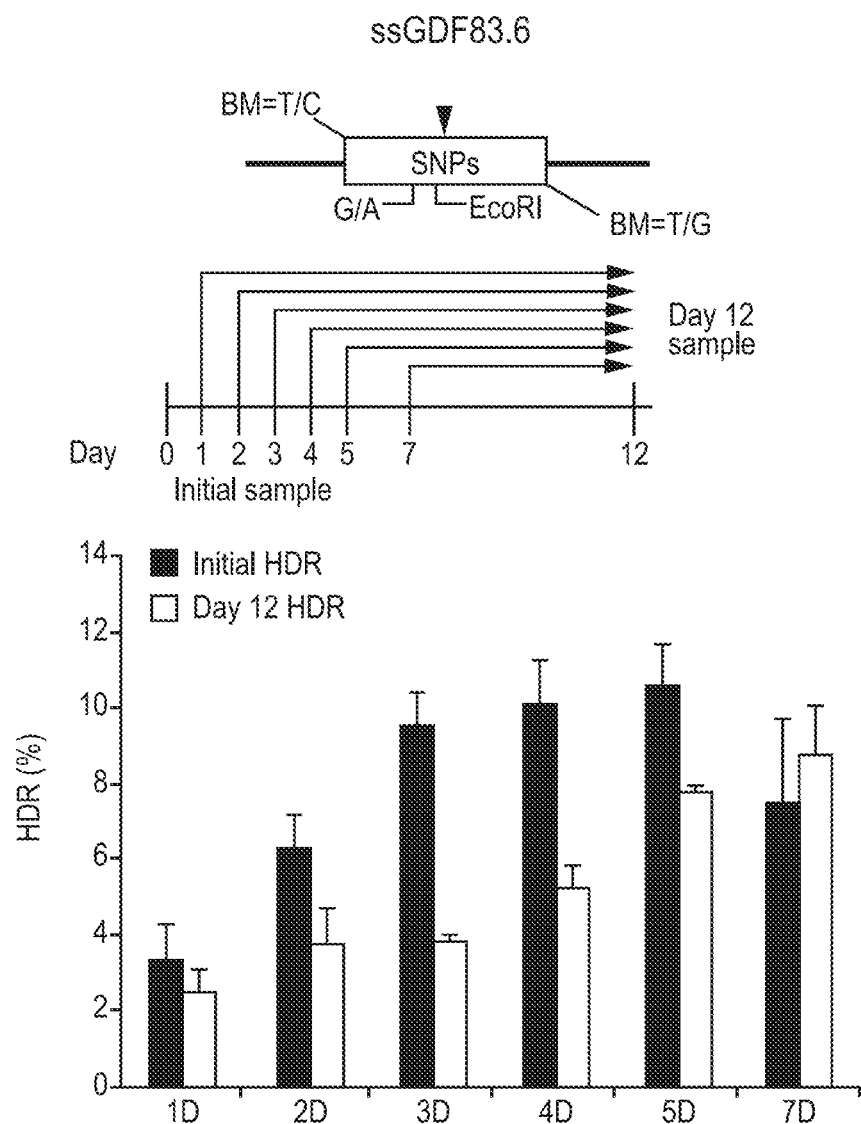
FIG. 45: A plot of data for hypothermic treatment maintenance of SNP HDR alleles. Pig fibroblasts were transfected with TALEN mRNA (1 µg) and oligos (3 µM). Cells from two independent transfections were pooled for each replicate and evenly distributed into six wells of a 6-well plate and cultured at 30° C. Samples were collected from these populations for RFLP analysis on days 1-7 (minus day 6, 1D to 7D along X-axis) post-transfection and the remaining cells were transferred to 37° C. Samples for each condition were collected again at day 12 for RFLP analysis. The average HDR and SEM (n=3) is shown at the initial collection and once again at day 12.

It was hypothesized that gene-editing is a dynamic process. TALEN cleavage and re-cleavage are theorized to be in flux with repair by NHEJ, HDR with oligo template, and HDR with the sister chromatid as template. It was hypothesized that the observed loss of SNP alleles might be reduced by extending the hypothermic treatment, slowing cell proliferation long enough to outlast the burst of TALEN activity from TALEN mRNA transfection. Indeed, and surprisingly, this extension almost tripled the level of SNP HDR-edited alleles recovered after extended culture (FIG. 45).

Figure 46:
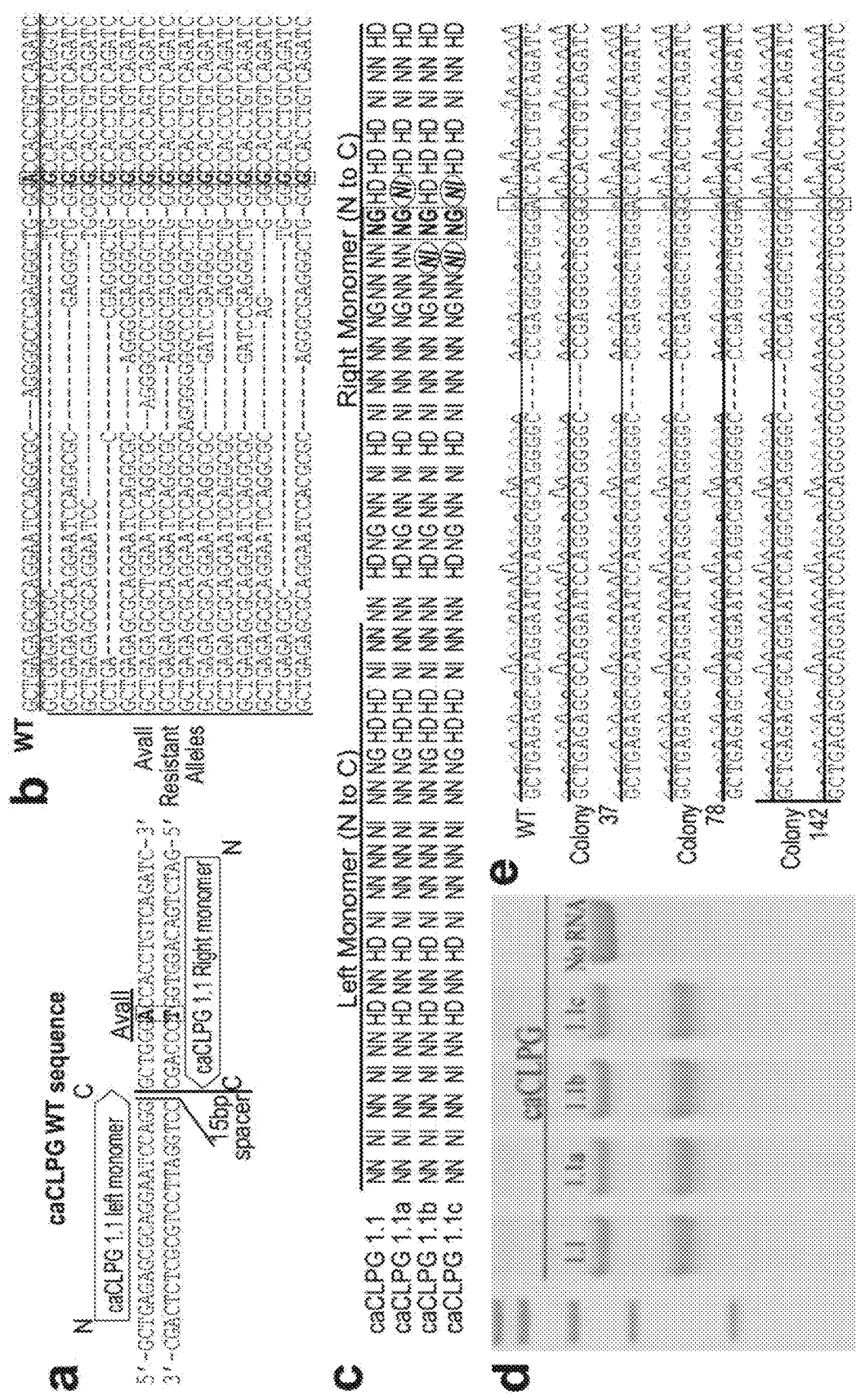
FIG. 46: Experimental results for TALENs made with intentional RVD mismatches to improve frequency of correct alleles when introducing a SNP. Panel a) shows a TALEN pair (caCLPG 1.1, SEQ ID NOs: 267-270, top to bottom, left to right) designed to target the caCLPG region. Oligo driven HDR was utilized to introduce the desired Adenine to Guanine SNP (the targeted Adenine is boxed). The desired SNP allowed genotyping by a loss of an AvaII restriction site. Each TALEN monomer is indicated in shading above their respective binding locations. Panel b) A caCLPG wildtype sequence is shown (SEQ ID NO:271). Each allele of single-cell derived colonies that were resistant to AvaII were sequenced (fourteen sequences with SEQ ID NOS: 272-277, 279, 278 and 280-285, from top to bottom). All of the alleles that contained the SNP of interest (boxed) also contained deletions (marked with dashes in the AvaII Resistant Allele sequences) or insertions (marked with dashes in the WT sequence). In panel c), intentional mismatches (italicized circled text) were introduced into the RVD sequence. The desired SNP (boxed) was in the right monomer of the TALEN. Panel d) shows TALEN activity as measured via a Cell assay. The percent of non-homologous end joining (% NHEJ) is indicated for each was measured. Panel e) shows both an alignment of a caCLPG wildtype sequence is shown (SEQ ID NO:294) with sequenced alleles of AvaII-resistant single-cell derived colonies produced with caCLPG 1.1c (six sequences, with SEQ ID NOS: 295, 298 and 297-300, top to bottom). The desired SNP is boxed. Colony 37 and 78 were heterozygous for the desired SNP and showed no additional indels. Colony 142 was homozygous for the desired SNP, but contained a 4 bp insertion on one allele.

For biomedical applications, alterations of bases besides the key bases that create the desired functionality is acceptable so long as the desired phenotype is achieved and the other changes are apparently without functional relevance. The inventors believe, however, that it is desirable for animals used in agriculture, to duplicate natural (native) alleles without further changes or to make only the intended edits without further changes. In contrast to the approaches where the mismatches are derived from successful introgression of the HDR construct, mismatches can be derived from changes in the RVD sequence. For TALENs, this process requires the TALEN monomers to be constructed with RVDs that do not bind to their corresponding nucleotides in the native alleles (FIG. 46 panel c). This concept of an intentional mismatch in the design of the nuclease (in this case TALENs) to prevent re-cutting of a desired is novel and operates under the following theory. TALENs can only tolerate some mismatches in their binding regions before their binding activity is essentially eliminated. Thus, it is possible to develop TALENs that have intentional mismatches with the native allele that will still cut, but as more mismatches are created, binding will be abolished. The theory of intentional mismatch is that after introgression of the desired allele, the new mismatch will have an additive effect to the engineered mismatches in the TALEN code to pass a critical tipping point to render the TALEN inactive. Counterintuitively, decreasing nuclease affinity for a target by intentional mismatching of RVDs provides a strategy to introgress a specific mutation down to a single nucleotide polymorphism (SNP), and reduce to undesired indels as a result of re-cutting.

Figure 66:
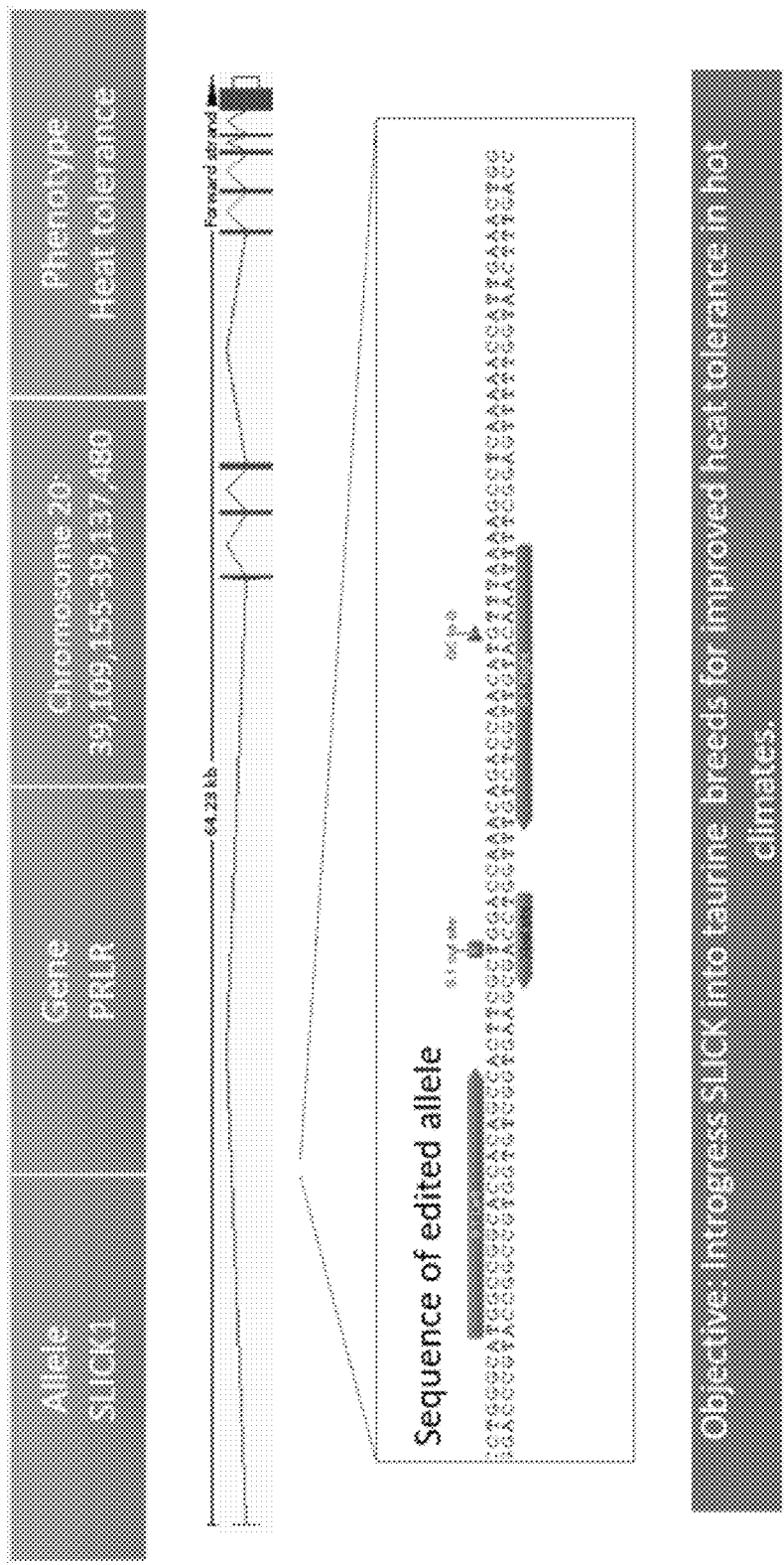
FIG. 66: Schematic of the *bovine* PRLR gene (SEQ ID NO: 525) and position within the genome. A mutation that leads to truncation of the PRLR gene is created, which corresponds to the SLICK 1 allele. The CG→G mutation causes a frame shift and termination at amino acid 461 (Trunc461). The XbaI site was included in one of the HDR template designs to enable RFLP (SEQ ID NOS: 383 and 384).
Figure 67:
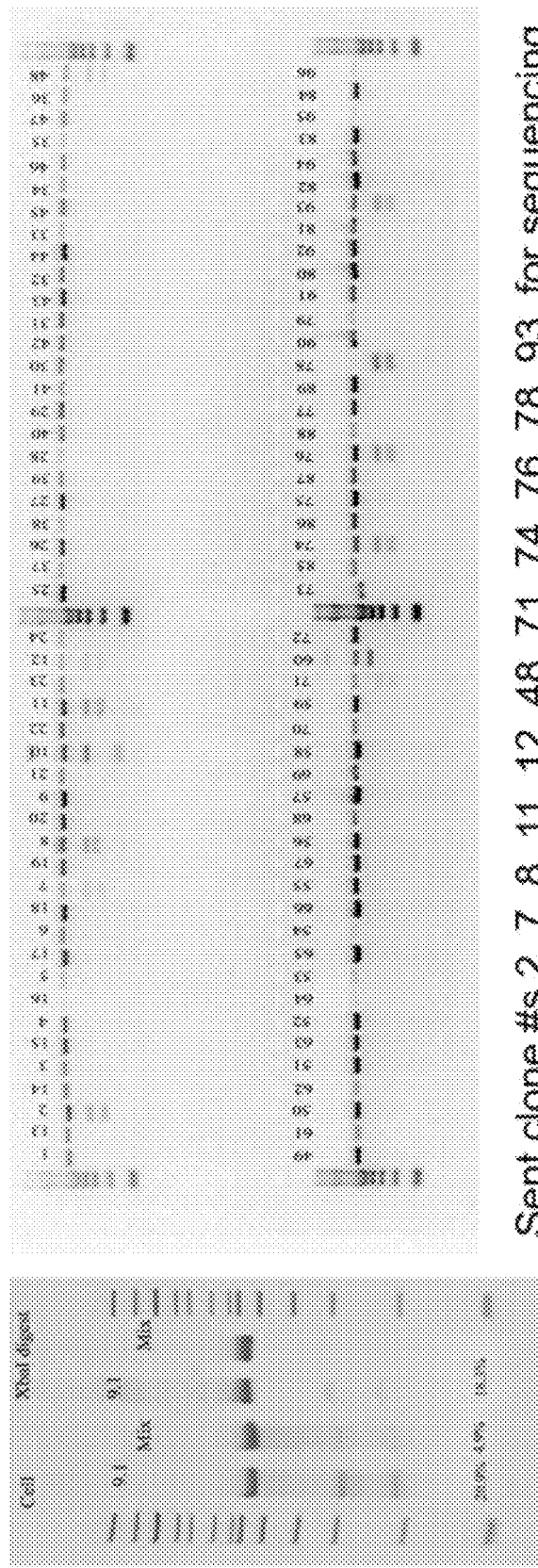
FIG. 67: Schematic of the *bovine* PRLR gene (SEQ ID NO: 525). Holstein cells were transfected with 1 μg PRLR9.1 TALENs along with 0.4 nmol of the HDR template, PRLR9.1 (SLICK1) XbaI RE site (SEQ ID NO: 383). Three days after transfection, the population of cells was screened for TALEN activity by Cell and RFLP assay (left gel). Remaining cells were re-plated for derivation of individual colonies and screened by RFLP assay (right gel). Many candidates were identified, and sequence analysis revealed that clones 11 and 93 were positive for precise introgression of SLICK1.
Figure 70:
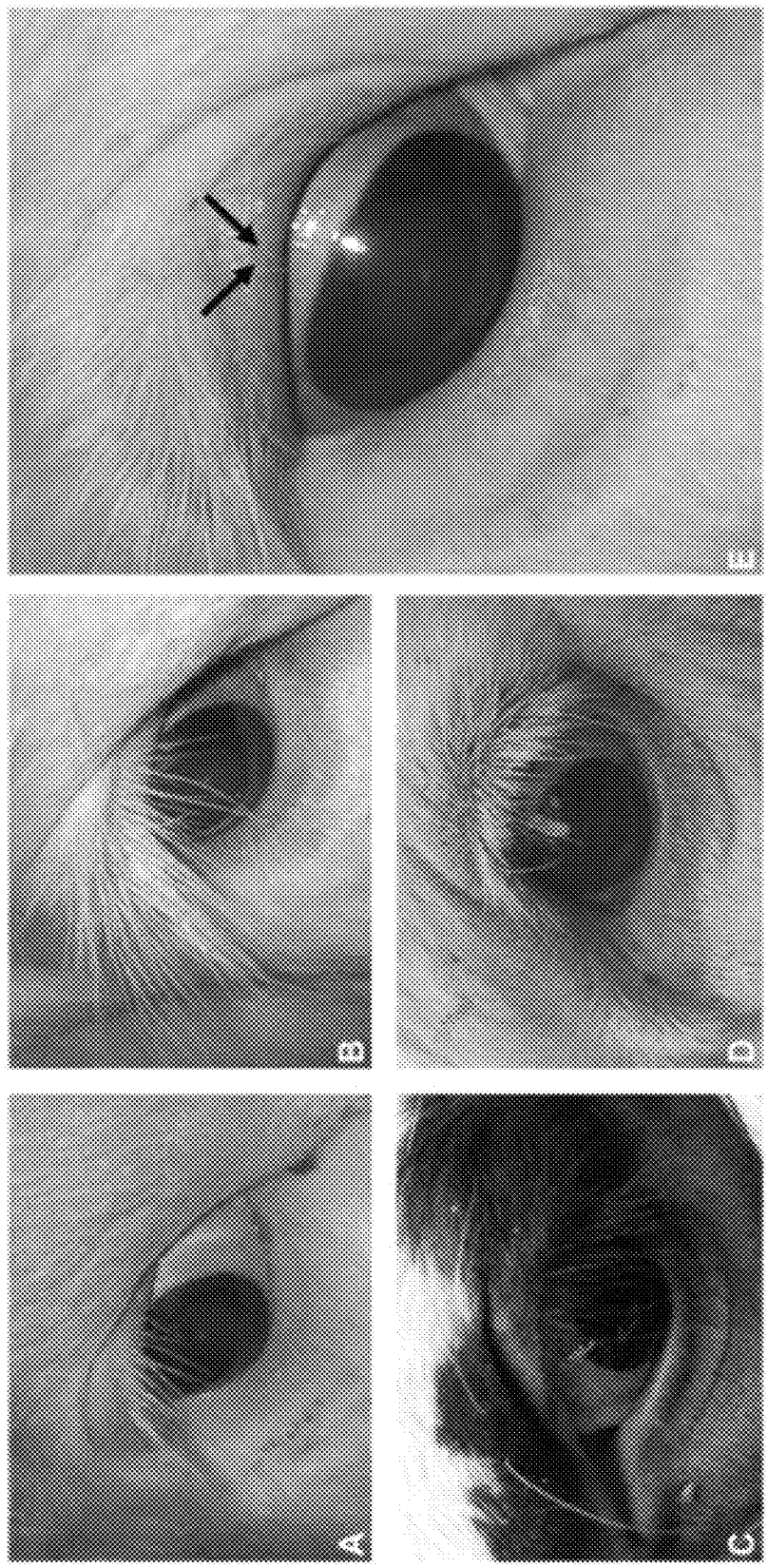
FIG. 70: Comparison of the eyelashes of a horned bull (A) as compared to POLLED cattle (B-E) with the same allele introgressed into the POLLED Holstein seen in FIGS. 68 and 69 (Allais-Bonnet et al., (2013) Novel Insights into the Bovine POLLED Phenotype and Horn Ontogenesis in Bovidae. PLoS ONE 8(5): e63512.doi:10.1371/journal.pone.0063512).
Figure 71:
FIG. 71: Picture of an Angus/Holstein crossbreed (see the World Wide Web (www) at albertachickensetc.punbb-hosting.com/viewtopic.php?id=15272).

As an example, a TALEN pair (caCLPG 1.1) was designed with zero mismatches to target the CLPG locus in the goat (Capra aegagrus hircus) genome (FIG. 46 panel a). The desired mutation was an adenine to guanine SNP, which has been linked to an increase in hindquarter muscle hypertrophy. The SNP allowed easy genotyping of colonies due to a loss of an AvaII restriction site. Initial restriction digest assays showed several colonies with promising results, however when the alleles of each colony were sequenced, zero of fourteen were our intended product as each contained an undesired indel in addition to the desired SNP (FIG. 46 panel b and Table 6 labeled Success rate using intentional mismatches). To test the intentional mismatch approach, an additional three TALEN pairs were developed with different numbers and locations of intentional mismatches (FIG. 46 panel c). These TALENs were able to cut the wild-type allele at similar frequencies to the original caCLPG1.1 TALEN pair (FIG. 46 panel d). To observe the effect on HDR and reducing of undesired indels, individual colonies were derived from cells transfected with caCLPG 1.1c (two mismatches) and the HDR template. In contrast to the results with the original caCLPG1.1 TALENs, three of fifteen (20%) of AvaII resistant colonies were positive for the desired SNP and contained no additional mutations (3/15=20%) (FIG. 46 panel e and Table 6). Thus, derivation of the intended allele was dependent on intentional mismatch. TALEN pair btPRLR 9.1 (see Tables 6, 10, and 14) was used to cause a frameshift in the *bovine* prolactin receptor gene (see FIGS. 66 and 67).

TABLE 6

Success Rate Using Intentional Mismatch
TABLE 6: Success of intentional Mismatch and HDR at Agriculturally relevant loci.

| Gene | Species/Cell type | Allele desired | Number of RVD mismatches | TALEN ID | RFLP pos. | Confirmed |
|---|---|---|---|---|---|---|
| CLPG | Goat/Fibroblasts | A to G | 0 | caCLPG1.1 | NA | 0/14 |
| CLPG | Goat/Fibroblasts | A to G | 2 | caCLPG1.1c | NA | 3/15 |
| DGAT | Cow/Fibroblasts | K232A | 0 | btDGAT 14.2 | 19/96 | 0/12 |
| DGAT | Cow/Fibroblasts | K232A | 1 | btDGAT 14.4 | 15/96 | 0/12 |
| DGAT | Cow/Fibroblasts | K232A | 1 | btDGAT 14.5 | 16/96 | 2/12 |
| DGAT | Cow/Fibroblasts | K232A | 1 | btDGAT 14.6 | 15/96 | 3/12 |
| PRLR | Cow/Fibroblasts | Trunc461 | 0 | btPRLR 9.1 | NA | 2/11 |
| SOCS2 | Pig/Fibroblasts | Trunc10 | 0 | ssSocs 2.1 | 75%[b] | |
| SLC35A3 | Cow/Fibroblasts | V180F[a] | 0 | SLC35A3 8.3 | 18%[b] | |

[a]Repair of the missense allele that results in complex vertebral malformation (Thomsen, B; Genome Res. 2006 Jan; 16(1): 97-105.)
[b]Percentage of HDR on the population level
CLPG (callipyge gene);
DGAT (Diacylglycerol O-Acyltransferase);
PRLR (Prolactin Receptor);
SOCS2 (Suppressor of cytokine signaling 2);
SLC35A3 (Solute Carrier Family 35 Member A3)

Figure 47:
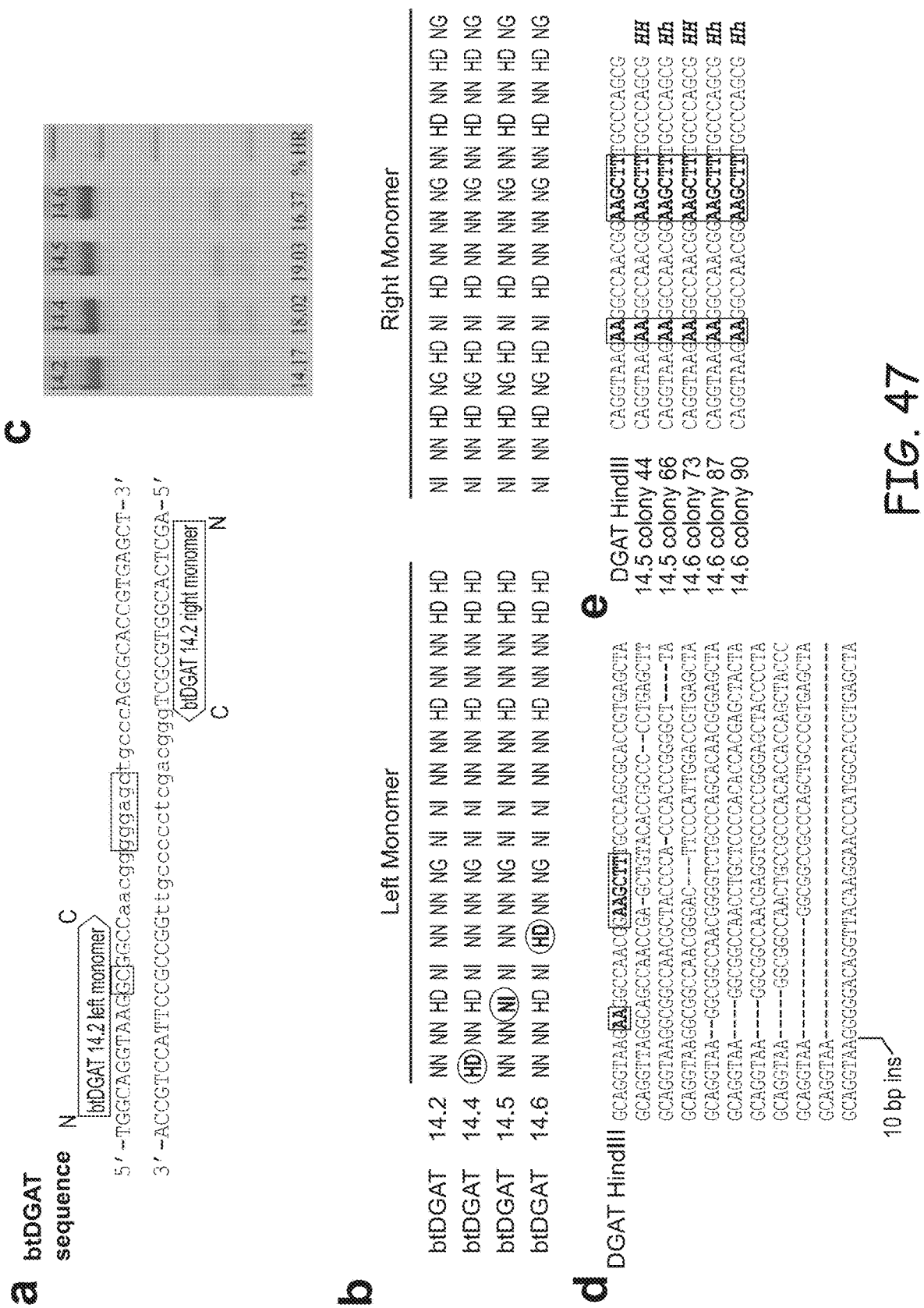
FIG. 47: Results for experiments to introgress a SNP with and without a mismatch in the targeting endonuclease. Panel a) shows a schematic of the *bovine* DGAT sequence around K323A (SEQ ID NOs: 301 and 302). The grey arrows represent the TALEN monomers where they bind to the DGAT sequence. The left arm consists of 16 RVDs, the right arm consists of 15 RVDs, and the spacer is 16 base pairs long. The GC and gga gct, boxed, are the targeted base pairs. The DGAT oligo converts the GC to an AA to create the desired DGAT mutant. As a marker for HDR, the boxed GGGAGC is converted to AAGCTT that creates a novel HindIII restriction site. Since this change is in the spacer, it should not affect TALEN binding as to not interfere with the intentional mismatch results. Panel b) DGAT TALEN RVD sequences. btDGAT 14.2 contains no intentional mismatches in the RVDs. btDGAT 14.4, 14.5, and 14.6 each contain one intentional RVD mismatch at either position 1, 3, or 5 of the left TALEN monomer (circled). Panel c) Bovine fibroblasts were transfected with 1 ug of talen and 0.4 nmoles of oligo. Three days after transfection cells were lysed, the DGAT sequence was amplified by PCR, digested with HindIII and ran on an acrylamide gel. The percent efficiency of HDR was determined by densitometry (HR). Panel d) Sequence analysis of colonies produce with the original 14.2 TALENs. Of twelve colonies, none that were positive for the HindIII RFLP contained the desired mutation due to indels overlapping the site. (From top to bottom, SEQ ID NOs: 311 to 319, 321). Panel e) Colonies derived from TALENs 14.5 and 14.6 produced the correct DGAT mutation and HindIII restriction site. These two TALEN pairs produced a total of two homozygous (HH) and three heterozygous (Hh) colonies. TALEN 14.4 did not produce any colonies with the correct DGAT mutation (data not shown), from top to bottom, SEQ ID NOs: 322 to 327.

In a further example, the intention was to alter specifically two bases in the *bovine* DGAT gene. As with the CLPG locus, attempts to introgress the desired mutation without intentional mismatch failed as 0/12 RFLP colonies that were positive for the HindIII site were free of indels (FIG. 47 panel d and Table 6). The intentional mismatch method was used, and found overall rates of HDR on the population level (FIG. 47 panel c). Sequencing from individual colonies however revealed that two of three of the intentional mismatch designs were successful, giving rise to 2/12 and 3/12 correct alleles for 14.5 and 14.6 respectively (FIG. 47 panel e and Table 6). As with the CLPG locus, derivation of the intended allele was dependent on RVD-encoded intentional mismatch. The data in Table 7 demonstrated that combining mRNAs encoding TALENS plus oligonucleotides as templates for directing HDR achieved several benchmarks for a genome-editing strategy: 1) only target nucleotides were changed and mRNA transfection avoided unintended integration of plasmid DNA, 2) gene edits were efficient; from about 10% for SNPs to above 50% for some larger alterations, and 3) the method was reliable; targeted alteration of 16/16 sites (15 genes) was achieved. The efficiency and precision reported here is very surprising.

evance was accomplished by interrupting coding sequences with 4 bp indels. This strategy was reliable and generally resulted in HDR-edits in about 40% of the clones (range 26-60%), and of those, up to one-third were homozygotes. At similar frequencies, a modified loxP (mloxP) site was integrated into ROSA26 and SRY loci in cattle and pigs that can be used as a landing pad (also referred to as a safe harbour) for insertion of novel sequences in livestock via recombinase-mediated cassette exchange. Previously, only NHEJ edits had been demonstrated for the Y chromosome of livestock, however, TALENs are suitable for direct stimulation of knockout/knock-in, at least as demonstrated in

TABLE 7

Frequencies for recovery of colonies with HDR alleles

| Reagent | ID | Species | Mutation type | at change | aa change | Day 3% HDR | HDR+ (%) | Bi-allelic HDR+ (%) |
|---|---|---|---|---|---|---|---|---|
| TALEN | ssLDLR2.1[3] | Pig ♀ | Ins/FS | 141(Ins4) | 47ΔPTC | 38 | 55/184 (30) | 4/184 (2) |
| TALEN | ssDAZL3.1[4] | Pig ♂ | Ins/FS | 173(Ins4) | 57ΔPTC | 25 | 34/92 (37) | 8/92 (9) |
| TALEN | ssDAZL3.1[Rep] | Pig ♂ | Ins/FS | 173(Ins4) | 57ΔPTC | 30 | 42/124 (34) | 7/124 (6) |
| TALEN | ssAPC14.2[b] | Pig ♂ | Ins/FS | 2703(Ins4) | 902ΔPTC | 48 | 22/40 (55) | 4/40 (10) |
| TALEN | ssAPC14.2[Rep] | Pig ♂ | Ins/FS | 2703(Ins4) | 902ΔPTC | 50 | 57/96 (60) | 19/96 (20) |
| TALEN | ssAPC14.2[Ld] | Pig ♂ | Ins/FS | 2703(Ins4) | 902ΔPTC | 34 | 21/81 (26) | 1/81 (1) |
| TALEN | ssTp53 | Pig ♂ | Ins/FS | 463(Ins4) | 154ΔPTC | 22 | 42/71 (59) | 12/71 (17) |
| TALEN | ssRAG2.1 | Pig ♂ | Ins/FS | 228(Ins4) | 76ΔPTC | 47 | 32/77 (42) | 13/77 (17) |
| TALEN | btRosa1.2[c] | Cow ♂ | Ins/mloxP | Ins34 | NA | 45 | 14/22 (64) | 7/22 (32) |
| TALEN | ssSRY3.2 | Pig ♂ | Ins/mloxP | Ins34 | NA | 30 | ND | ND |
| TALEN | ssKissR3.2 | Pig ♂ | Ins/FS | 322(Ins6) 323(del2) | 107ΔPTC | 53 | 57/96 (59) | 17/96 (18) |
| TALEN | btGDFB3.1 | Cow ♂ | del/FS | 821(del11) | FS | ~10 | 7/72 (10) | 2/73 (3) |
| TALEN | ssEIF4GI4.1 | Pig ♂ | SNPs | G2014A T2017C C2019T | N572D L673F | 52 | 68/102 (67) | 40/102 (39) |
| TALEN | btGDFB3.6N | Cow ♂ | SNPs | G938A T945C | C313Y | 18 | 8/94 (9) | 3/94 (3) |
| TALEN | btGDFB3.6N[d] | Cow ♂ | SNP | G938A | C313Y | NA | 7/105 (7) | 2/105 (2) |
| TALEN | ssP65.8 | Pig ♂ | SNP | T1591C | S531P | 18 | 6/40 (15) | 3/40 (8) |
| TALEN | ssP65.8[Rep] | Pig ♂ | SNP | T1991C | S531P | 7 | 9/63 (14) | 3/63 (8) |
| TALEN | ssGDF83.6[d] | Pig ♂ | SNP | G938A | C313Y | NA | 3/90 (3) | 1/90 (1) |
| TALEN | caFecB6.1 | Goat ♂ | SNP | A747G | Q249R | 17 | 17/72 (24) | 3/72 (4) |
| TALEN | caCLPG1.1 | Goat ♂ | SNP | A→G | Non-coding | 4 | ND | ND |
| CRISPR | ssP68 G1s | Pig ♂ | SNP | T1591C | S531P | 6 | 6/96 (6) | 2/96 (2) |
| CRISPR | ssP65 G2a | Pig ♂ | SNP | T1591C | S531P | 3 | 2/45 (4) | 0/45 |
| CRISPR | APC14.2 G1a | Pig ♂ | Ins/FS | 2703 (Ins4) | 902ΔPTC | 32 | ND | ND |

Two concerns in gene editing are stabilizing the changes at the targeted site and avoiding modification of unintended sites. With regard to the first, evidence was found that HDR-edits directing single basepair changes, i.e., SNPs, could be lost (FIG. 41 and FIG. 42 panel b). Based on the prediction that a thymidine preceding the targeted DNA sequence influences TAL binding, it was attempted to block re-cleavage of introgressed alleles by introducing BMs. However, it was found that BMs did not prevent TALEN activity and re-cleavage of edited alleles (FIG. 41 and FIGS. 43 and 44). In contrast, introduction of multiple SNPs or additional sequence (FIG. 37A and FIG. 44) resulted in more stable HDR226 edits. Surprisingly, it was found that extension of hypothermic culture resulted in the stabilization of introgressed SNP alleles. It is theorized that hypothermia slows cell proliferation primarily by prolonging G1-phase of the cell cycle so that this treatment differentially favors oligo-HDR versus sister chromatid templated repair in a cell-cycle dependent manner. Regardless of the mechanism, this approach offers a straight-forward strategy for recovering cells with precise introgression of SNP alleles.

A variety of objectives were achieved by precise gene editing (Table 7). Knockout of genes of biomedical relmice. Also, there was an introgression of native alleles between species/breeds, including the double-muscling mutations of GDF8 (SNP G938A23, 25 or 821del1123-25 from Piedmontese and Belgian Blue cattle respectively) into the genome of Wagyu cattle and Landrace pigs.

In some cases gene targeting with a standard plasmid vector and homologous recombination cassette will not be suitable for transgene delivery. Some cases could include when attempting to place a transgene in a site surrounded by repetitive elements or low complexity DNA. In these cases, the short homology required by oligo HDR may be preferred to integrate a transgene into a small region of unique sequence. However, the cargo capacity for oligo HDR is not sufficient to deliver a transgene. To circumvent this problem, we sought to combine the efficiency of oligo HDR for delivery of small insertions (e.g., LoxP sites) and the large cargo capacity of recombinase mediated cassette exchange (RMCE) for site specific integration of transgenes. Recombinase-mediated cassette exchange (RMCE) is a method based on the features of site-specific recombination processes (SSRs). This process allows for systematic, repeated modification of higher eukaryotic genomes by targeted integration. This result is achieved with RMCE by the clean exchange of a preexisting gene cassette for an analogous cassette carrying the gene of interest (GOI).

Figure 48:
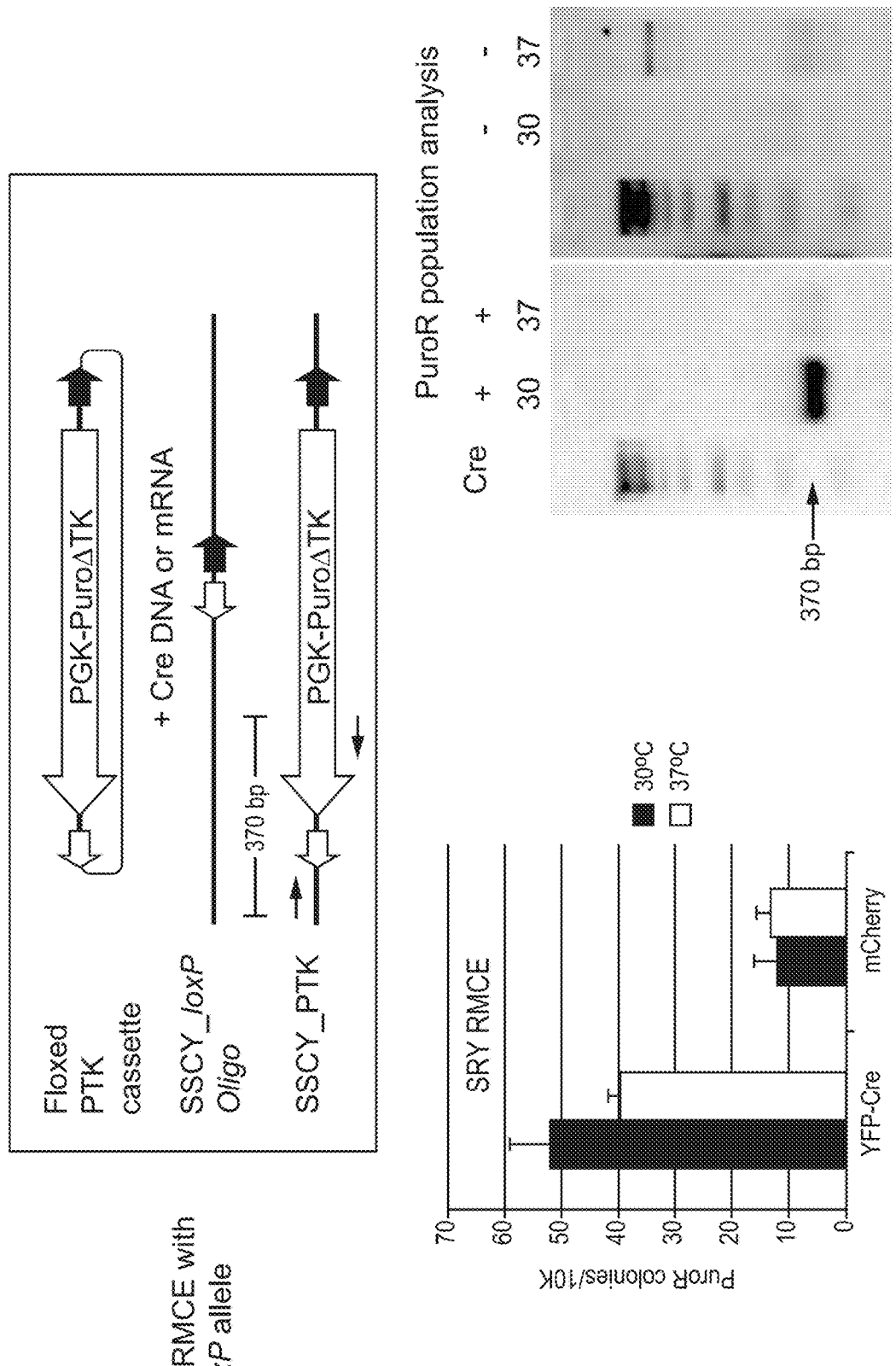
FIG. 48: Sets forth the process of TALEN-HDR/RMCE. The foxed cassette is transfected along with TALENs compatible with the oligo, the loxP oligo and a source of Cre recombinase. The bar graph shows the number of puromycin resistant colonies produced by this method when YFC-Cre versus mCherry was included in the transfection. To confirm targeting to the SRY locus, PCR was conducted across the predicted junction (shown) will result in a 370 bp product. This product is apparent only when Cre is included.

There are problems with using RMCE to make genetically modified animals in the higher vertebrates, such as livestock. A significant problem is that due to the short lifespan of primary livestock cells prior to senescence, this process must occur in a single treatment. It would be possible in some other types of cells to perform the RMCE process serially wherein a cellular clone with the inserted LoxP site is isolated prior to transfection with the RCME machinery and isolation of clones to identify those with the correct targeting event. Applicants attempted to perform this process by simultaneously transfecting primary fibroblasts with four components: 1) SRY TALENs 2) an oligo with homology to SRY that includes two RMCE compatible loxP sites 3) a RMCE compatible transgene and 4) a source of Cre recombinase. In FIG. 48, the RMCE transgene was the puromycin resistance gene enabling selection for integration events. The number of puromycin resistant colonies was significantly increased when YFC-Cre was provided in contrast to the control group that included a mCherry expression cassette in place of YFC-Cre. Among puromycin resistant colonies (selected from cells treated for 3 days at either 30° C. or 37° C.) eight (n=95) and four percent (n=95) were positive for correct targeting of the RMCE vector. These results showed that it was possible to simultaneously provide the TALENS, HDR template containing loxP site, a transgene of interest flanked by loxP, and a Cre-recombinase mRNA resulting in RMCE mediated recombination into a TALEN targeted locus.

Embodiments of the invention include a process of homology dependent repair using an HDR template with a sequence that is introduced into the host cell or embryo that is a landing pad, e.g., for exogenous genes. The term landing pad is used according to its customary meaning to refer to a site-specific recognition sequence or a site-specific recombination site that is stably integrated into the genome of a host cell. Presence in the host genome of the heterologous site-specific recombination sequence allows a recombinase to mediate site-specific insertion of a heterologous polynucleotide or an exogenous into the host genome.

Embodiments include, kits, uses, compositions, and a method of creating a landing pad in a chromosomal DNA of a cell, comprising introducing a targeted nuclease system and a HDR template into the cell, with the targeted nuclease system comprising a DNA-binding member for specifically binding an endogenous cognate sequence in the chromosomal DNA, wherein the targeted nuclease system and the HDR template operate to alter the chromosomal DNA to have identity to the HDR template sequence, wherein the HDR template sequence comprises a landing pad. The method may be applied in a primary cell or embryo. Embodiments include introducing the targeting nuclease, the HDR template encoding the landing pad, the exogenous gene that is compatible with the landing pad, and a source of recombinase compatible with the same; all of these may be introduced simultaneously. The term simultaneous is in contrast to a hypothetical process of treating cells multiple times in seriatim; the term must be kept in context, with an appreciation that it refers to a literally simultaneous introduction or an introduction calculated to having all of the factors bioactive at the same time. The landing site may be, e.g., RMCE compatible loxP sites, FRT, rox, VloxP, SloxP. The recombinase may be, e.g., Cre, FLP, Dre.

In other experiments, for improvement of animal welfare, the POLLED allele was transferred from a beef producing breed into cells from horned dairy cattle. A candidate SNP allele for African swine fever virus resilience (T1591C of p6539) was transferred from warthog to the genome of conventional swine cells and introgressed sheep SNPs responsible for elevated fecundity (FecB; BMPR-IB) and parent-of-origin dependent muscle hypertrophy (Callipyge) were transferred into the goat genome. Such introgression was previously impossible by breeding and will enable the assessment of defined genetic effects in related species. Non-meiotic allele introgression has not conventionally been possible without selective enrichment, and efficiencies reported herein are $10^3$-$10^4$-fold higher than results previously obtained with selection. Such high levels of unselected single-allele introgression suggests it will be feasible to alter multiple alleles in a single generation of farm animals, decreasing the impact of long generation intervals on genetic improvement. Furthermore, efficient editing to homozygosity will greatly increase the rate of introgression per breeding interval.

As further elaboration of inventions described here customized endonucleases were used to generate live animals with precise edits at two independent loci. Pigs edited to disrupt the DAZL gene are useful as a model for studying the restoration of human fertility by germ cell transplantation, or for the production of genetically modified offspring by transfer of genetically modified germline stem cells as demonstrated in pigs, goats, and rodents. Gene edited alleles of APC provide a size-relevant model of colon cancer for pre-clinical evaluation of therapeutics, surgical intervention or detection modalities. These results demonstrate an introduction of genetic modifications, including polymorphisms, and including modifications that mimic natural polymorphisms into livestock. Gene-editing technology is useful to accelerate genetic improvement of agricultural products by intra- and interspecific allele introgression to help meet the growing global demand for animal protein. It also is useful for the development of large animals with defined genetics for drug and device testing, or for the development of therapeutic cells and organs. Other uses include making cells that can be used in vitro for research to understand the mechanisms of congenital and infectious disease, and to improve the methods for gene editing and control.

Gross Chromosomal Deletions and Inversions; Genetically Modified Animals

Experiments were performed with TALENs directed to a plurality of DNA sites. The sites were separated by several thousand base pairs. It was observed that the DNA could be rejoined with the deletion of the entire region between the sites. Embodiments include, for example, sites separated by a distance between 1-5 megabases or between 50% and 80% of a chromosome, or between about 100 and about 1,000,000 basepairs; artisans will immediately appreciate that all the ranges and values within the explicitly stated ranges are contemplated, e.g., from about 1,000 to about 10,000 basepairs or from about 500 to about 500,000 basepairs. Alternatively, exogenous DNA may be added to the cell or embryo for insertion of the exogenous DNA, or template-driven repair of the DNA between the sites. Modification at a plurality of sites may be used to make genetically modified cells, embryos, artiodactyls, and livestock. Example 5 describes the deletion of several thousand basepairs of DNA, with rejoining of the ends verified biochemically.

Unexpectedly, TALEN-cleavage at separated sites also resulted in frequent inversion of the entire region between TALEN targets. As an additional surprise, as detailed in Example 5, these inversions were accomplished with great fidelity. Forty one out of 43 of the tested inversions were positive at both the 5' and 3' junctions. And sequencing of PCR products confirmed both deletion and inversion events with addition or deletion of very few nucleotides at their junctions (FIG. 11, 12). This result was highly surprising and unprecedented. Cells or embryos with these deletions or inversions have many uses as assay tools for genetics.

These cells are also useful for making animals, livestock, and animal models. The term animal model includes, for example, zebrafish, dogs, mice, rats or other laboratory animals. Large deletions provide for gene inactivation. Also, for instance, a deletion strain may be made of cells, livestock, or animal models. Crossing the deletion strains with an organism bearing a mutation for comparison to a wild-type helps to rapidly and conveniently localize and identify the mutation locus. Deletion strains are well known in these arts and involve sets of organisms made with a series of deletions in a gene. Deletion mapping involves crossing a strain which has a point mutation in a gene with the deletion strains. Wherever recombination occurs between the two strains to produce a wild-type (+) gene, the mutation cannot lie within the region of the deletion. If recombination cannot produce any wild-type genes, then it is reasonable to conclude that the point mutation and deletion are found within the same stretch of DNA. This can be used for example to identify causative mutations, or to identify polymorphisms underlying quantitative trait loci.

Cells, embryos, livestock, artiodactyls, and animal models with inversions are also useful for fixing a genetic trait in progeny of an organism or an animal line or animal breed. Recombinations typically occur between homologous regions of matching chromosomes during meiosis. Inversion of a chromosomal region destroys homology and suppresses meiotic recombination. Methods and compositions described herein may be used to make such organisms or animals. For example, DNA in a somatic *bovine* or porcine cell may be cut at a plurality of loci by TALENs, and cells with an inversion may be isolated, or cells expressing reporters may be used as likely candidates for successful inversions. The cells may be used to clone animals that harbor chromosomal regions that are incapable of meiotic recombination. Alternatively, it is expected that inversions will also occur at reasonable frequencies in embryos treated with multiple TALEN-pairs at plurality of sites.

An embodiment of this method is identifying a DNA region encoding a genetic trait and cutting a DNA in a cell or embryo on each side of the encoded trait at sites using a plurality of TALENs. The modified cell or embryo may be used for creating a genetically modified animal. The method may comprise isolating a genetically modified animal that has the inversion.

Animals Genetically Modified without any Reporters; TALENs Techniques; Allelic Migration Certain embodiments of the invention are directed to processes of modifying cells or embryos without the use of reporters and/or selection markers. In general, it was initially observed that the frequency of TALEN-modified cells decreases significantly over time in the absence of enrichment or selection methods such as the use of reporter genes. This observation lead to approaches such as the co-transfection, co-selection technique reported herein that involves reporter genes.

It has been discovered, however, that TALENs modification can be performed with an efficiency that is so great that reporters are not needed and their use merely delays the creation of transgenic animal lines. Without being bound to a particular theory, a number of factors independently contributed to the invention of the reporter-free embodiments. One is the realization that TALENs tend to act quickly and at a high efficiency. However, TALENs modifications tended to be unstable over a time frame of several days such that efficiencies can seem to be low depending on the time of sampling. Further, it was conventional wisdom that only stably modified organisms should be used to make transgenic animals so that there is little incentive to understand short-term modifications. There is an incentive to use cell survival genes to select for stable incorporation, as is conventionally done in other systems. Another factor is that TALENs mRNA is unexpectedly effective as compared to vectors that express the TALENs. Direct introduction of mRNA encoding TALENs is, in general, useful, and was used in Examples 12 to 17.

Another factor is that, when an HDR template is desired, direct introduction of ssDNA, e.g., single stranded (ss) oligonucleotides, is useful, as demonstrated in Example 11. A confounding effect is that the timing of the delivery of ssDNA was important. In Example 11, delivery of the ss oligonucleotides at the same time as the TALENs encoded from plasmid DNA was not effective, but delaying introduction of the ss oligonucleotides for 24 hours resulted in high efficiencies. On the other hand, Example 15 showed that simultaneous introduction of ss oligonucleotide templates and TALENs mRNA was effective. Since TALENs were introduced in Example 11 as plasmid DNA expression cassettes, there may have been 12 or more hours of delay between transfection and accumulation of enough TALEN protein to begin cleaving the target. Perhaps the oligonucleotides introduced with the TALENs in Example 11 were degraded by the cells or otherwise un-available (compartmentalized or in complex with proteins) to act as template for HR at the same time that TALENs were actively cleaving the target. Another confounding factor, surprisingly, was that the ss nucleotides have a biphasic effect (Example 15). That is to say, too little or too much ss oligonucleotide results in a low frequency of HDR. Embodiments of the invention include those wherein the ssDNA is introduced into the cell after a vector encoding a TALEN is introduced into the cell, for instance, between about 8 hours and about 7 days afterwards; artisans will immediately appreciate that all the ranges and values within the explicitly stated ranges are contemplated, e.g., from about 1 to about 3 days hours. Embodiments of the invention include those wherein the ssDNA is introduced into the cell at about the same time as mRNA encoding a TALENs is directly introduced, with the term "about the same time" meaning within less than about 7 hours of each other.

Another factor contributing to discovery of reporter-free embodiments was that there is an unexpected synergy between ssDNA (ss oligonucleotide) templates and TALENs activity. For example, delivery of 0.5-10 micrograms TALEN-encoding mRNAs to 500,000-750,000 cells by nucleofection followed by 3 days of culture at 30 degrees Celsius results in consistent levels of modification. But supplementation of these same conditions with 0.2-1.6 nMol of ssODN led to an increase in TALENs activity, as observed by increased NHEJ as assayed by SURVEYOR assay (Example 15). Typically, a transfection consists of 1-4 micrograms of TALEN mRNA and 0.2-0.4 nMol of ssDNA. Embodiments include introducing to a cell or an embryo, an amount of TALEN mRNA that is more than about 0.05 µg per 500,000 cells, or in a range of from about 0.05 µg to about 100 µg per 500,000 cells; artisans will immediately appreciate that all the ranges and values within the explicitly stated ranges are contemplated. Embodiments include further introducing ssDNA at a concentration of more than about 0.02 nMol or in a range of from about 0.01 to about 10 nMol of ssDNA.

The term direct introduction, e.g., direct mRNA introduction, refers to introduction of mRNA material. In contrast, introduction by means of a vector encoding the mRNA is termed indirect introduction. Many processes of direct introduction are known, e.g., electroporation, transfection, lipofection, liposome, nucleofection, biolistic particles, nanoparticles, lipid transfection, electrofusion, and direct injection.

Certain embodiments of the invention are directed to processes of modifying cells or embryos without the use of reporters and/or selection markers. In general, it was observed that TALENs and CRISPR/Cas9 modifications were unstable over a time frame of several days. Accordingly, processes described herein for stabilizing changes may be used, as well as other processes described in US 2013/0117870: for instance, direct mRNA introduction and/or use of ssDNA templates. The term direct introduction, e.g., direct mRNA introduction, refers to introduction of mRNA material. In contrast, introduction by means of a vector encoding the mRNA is termed indirect introduction. Many processes of direct introduction are known, e.g., electroporation, transfection, lipofection, liposome, nucleofection, biolistic particles, nanoparticles, lipid transfection, electrofusion, and direct injection.

Founder animals can be immediately created from modified cells or embryos without the need to create initially modified animals that are subsequently bred to create the basis for a new transgenic line. The term founder or founder animal is used to refer to a first-generation ("F0") transgenic animal that develops directly from the cloned cell or treated/injected embryo that is modified. Methods reported herein provide for creation of founders genetically modified only at the chromosomal target site, and without intermediate steps of breeding and/or inbreeding. Moreover, embodiments include founders that are homozygous for the modification. The founders may be prepared without ever exposing cells and/or embryos to reporter genes (and/or selection marker genes).

Embodiments include a method of making a genetically modified animal, said method comprising exposing embryos or cells to an mRNA encoding a TALEN, with the TALEN specifically binding to a chromosomal target site in the embryos or cells, cloning the cells in a surrogate mother or implanting the embryos in a surrogate mother, with the surrogate mother gestating an animal that is genetically modified without a reporter gene and only at the chromosomal target site bound by the TALEN. The animal may be free of all reporter genes or may be free of selection markers, e.g., is free of selection markers but has a reporter such as a fluorescent protein. Options include directly introducing the TALENs as mRNA and/or a ss oligonucleotide that provides a template for a genetic modification, e.g., an allele.

A method of making a genetically modified animal comprises introducing TALENs and/or vectors into cultured cells, e.g., primary livestock cells. The TALENs are directed to specific chromosomal sites and cause a genetic alteration at the site. An HDR template may also be introduced into the cell, e.g., as a double stranded vector, single stranded DNA, or directly as a ss nucleotide. The cultured cells are subsequently cultured to form colonies of clonal cells. The colonies are tested by PCR and/or sequenced, or otherwise assayed for a genetic modification, preferably without a reporter gene and/or without a selection marker. Cells are taken from colonies that are genetically modified at the intended site and used in cloning. For example, from 10 to 50,000 cells are used to make from 10 to 50,000 embryos that are implanted into surrogates, e.g., in sets of 1-500 embryos per surrogate; artisans will immediately appreciate that all the ranges and values within the explicitly stated ranges are contemplated. Embodiments comprise exposing the cells to the TALEN without a reporter gene, creating colonies of clonal cells, and testing a subset of members of the colonies to identify colonies incorporating the modification at the chromosomal target site.

Processes of making colonies of clonal cells from cultured cells are known. One such method involves dispersing cells from a first culture into a second culture wherein the various cells are not in contact with each other, e.g., by diluting the cells into multiwall plates or into a plate with a relatively large surface area for the number of cells placed therein. The cells are cultured for a period of time that allows the cells to multiply. The multiplying cells are cultured in conditions where they are not likely to move far away from their original location. As a result, a user may observe the cells after the period of time and see various colonies that are all made of a single cell and its progeny. A subset of the cells in the colony may be sampled without destroying the other cells in the colony.

Assays for a genetic modification may include destructive assays, meaning an assay that destroys the cell that is tested to determine if it has a certain property. Destructive assays provide an opportunity to rapidly, thoroughly, and directly test for a medication. Destructive assays are made practical by a taking a sample of a clonal colony. Many such assays are highly efficient, particularly when the intended modification is known. For example, PCR may be performed to identify indels or mismatches in pre-existing sequences, or to detect a sequence of a HDR template. Or, for example, cellular DNA may be nucleolytically assayed, e.g., to determine if a novel nuclease target sequence has been successfully introduced or knocked-out. Example 17 uses a nucleolytic destructive assay. Other processes may be used that involve, e.g., sequencing or SDS-PAGE to find a band that is indicative of a modification. Other processes may be used that involve, e.g., sequencing or SDS-PAGE to find a band that is indicative of a modification. Testing processes may be, e.g., chosen from the group consisting of a nucleolytic assay, sequencing, PAGE, PCR, primer extension, or hybridization.

Allele migration has many important applications. The Allelic Migration Table, below, describes certain genes and their applications. Artisans reading this application will be able to make and use the migrations and resultant cells and animals. Artisans can readily apply the processes set forth herein for the use of these alleles as templates or targets for disruption. Embodiments include making a genetically modified cell or animal (for instance, a lab animal, an F0 founder, or animal line) that has a genome with a has received a gene from the Table, e.g., by insertion or template-driven allele migration. Alleles for some genes are reported to provide livestock production advantages, but are at very low frequencies or are absent in some breeds or species (see items 1-9). Introgression of these alleles can be of significant value for production traits. For example, the Polled allele (item 1) from beef breeds results in animals that do not have horns, whereas dairy breeds do not have this allele so have horns and need to be dehorned as a production practice. Allele migration from beef breeds into horned (dairy) breeds will lead to hornless dairy cattle which is has value for both production and animal welfare. Other examples relate to alleles that can increase or enhance characteristics of agricultural products such as meat (items 4-6) and milk (items 7-8). Item 9 is useful for disease resistance.

Many commercial and commonly used animal breeds have been carefully bred to establish desirable traits but, in the process of that breeding, have accumulated genetic errors that reduce their reproductive success because of losses in fertility or by increasing miscarriages. Deleterious alleles for some genes are present in animal populations. As explained elsewhere herein, the inventive techniques provide for changing alleles only at an intended location in a target animal, without other modifications resulting from genetic tools or from meiotic recombinations. Therefore, for the first time, it is possible to clean-up the genetic errors that have accumulated in livestock and animal breeds without disrupting the genome of the animals and, consequently, disrupting traits or causing unintended consequences. Alleles for some genes can be used to control animal fertility for genetic control of breeding stock (items 2-3).

Many useful animal models can be made. Certain alleles are useful, see items 10-39. Some of these are established in animals. Others of the genes are known to cause human disease, so introgressing these alleles into livestock, lab animals, or other animals is useful to create biomedical models of human disease.

Embodiments of the invention include a method of making a genetically modified animal, said method comprising exposing embryos or cells to an mRNA encoding a TALEN, with the TALEN specifically binding to a target chromosomal site in the embryos or cells, cloning the cells in a surrogate mother or implanting the embryos in a surrogate mother, with the surrogate mother thereby gestating an animal that is genetically modified without a reporter gene and only at the TALEN targeted chromosomal site wherein the allele is a member of the group consisting of (a) horn polled locus (b) a gene recessive for fertility defects, e.g., CWC15 and/or ApaF1 (c) genes for enhancing a livestock trait, e.g., meat production (GDF8, IGF2, SOCS2, or a combination thereof) and/or milk production (DGAT1 and/or ABCG2) (d) a gene for resistance to African swine fever (P65/RELA) (e) a gene for reduction of animal size (GHRHR) (f) genes that potential tumor growth (e.g., TP53, APC, PTEN, RB1, Smad4, BUB1B, BRCA1, BRCA2, ST14 or a combination thereof) (g) human oncogenes for animal models of cancer (e.g., AKT1, EGF, EGFR, KRAS, PDGFRA/B or a combination thereof) (h) genes in animal models for hypercholesterolemia (to induce atherosclerosis, stroke, and Alzheimer's disease models), e.g., LDLR, ApoE, ApoB or a combination thereof (i) Inflammatory Bowel disease, e.g., NOD2 (j) spina bifida, e.g., VANGL1 and/or VANGL2 (k) pulmonary hypertension, e.g., miR-145 (1) genes for cardiac defects, e.g., BMP10, SOS1, PTPN11, Nrg1, Kir6.2, GATA4, Hand2, or a combination thereof and (1) celiac disease genes, e.g., HLA-DQA1.

Movement of Alleles

Some livestock traits are related to alleles such as polymorphisms (large or small), single nucleotide polymorphisms, deletions, insertions, or other variations. For instance, a myostatin allele (an 11-bp deletion) from Belgian Blue cattle causes a double-muscling phenotype. Example 6 shows, using the Belgian Blue allele, how to precisely transfer specific alleles from one livestock breed to another by homology-dependent repair (HDR). Bovine fibroblasts received the allele and may readily be used to make transgenic cattle. This allele does not interfere with normal development and the methods taught herein place the allele with precision and without disruption of other genes or the incorporation of exogenous genes. As already discussed, results presented herein show that the frequency of allele conversion in livestock fibroblasts is high when sister chromatids are used for an HDR template, therefore allele introgression into one sister chromatid can be anticipated frequently to result in homozygosity.

An embodiment of this invention is a method of transfer of an allele from a first livestock line or breed to a second livestock line or breed, comprising cutting DNA with a pair of TALENs in a cell or embryo of the second livestock line/breed in a presence of a nucleic acid that encodes the allele of the first livestock line/breed. The embryo or cell may be used to create an animal of the second line/breed that has the allele of the first line/breed. The DNA that encodes the allele provides a template for homology-dependent repair. As a template, it has homology to portions of the DNA on each side of the cut and also contains the desired allele.

Embodiments of the invention comprise moving a plurality of alleles from one breed to another breed. For instance, alleles may be moved from Wagyu or Nelore cattle to Belgian Blue cattle, or vice versa. As set forth elsewhere herein, the TALENs may be delivered a protein or encoded by a nucleic acid, e.g., an mRNA or a vector. A reporter may also be transfected into the cell or embryo and used as a basis for selecting TALEN-modified cells. The reporter may be assayed non-destructively and/or may comprise a selection marker. Similarly, allele migration may be practiced in an animal model.

A population or species of organisms typically includes multiple alleles at each locus among various individuals. Allelic variation at a locus is measurable as the number of alleles (polymorphisms) present, or the proportion of heterozygotes in the population. For example, at the gene locus for the ABO blood type carbohydrate antigens in humans, classical genetics recognizes three alleles, IA, IB, and IO, that determine compatibility of blood transfusions. An allele is a term that means one of two or more forms of a gene.

In livestock, many alleles are known to be linked to various traits such as production traits, type traits, workability traits, and other functional traits. Artisans are accustomed to monitoring and quantifying these traits, e.g., Visscher et al., Livestock Production Science, 40 (1994) 123-137, U.S. Pat. No. 7,709,206, US 2001/0016315, US 2011/0023140, and US 2005/0153317. Accordingly, the allele that is transferred may be linked to a trait or chosen from a trait in the group consisting of a production trait, a type trait, a workability trait, a fertility trait, a mothering trait, and a disease resistance trait.

The term natural allele in the context of genetic modification means an allele found in nature in the same species of organism that is being modified. The term novel allele means a non-natural allele. A human allele placed into a goat is a novel allele. The term synthetic allele means an allele that is not found in nature. Thus a natural allele is a variation already existing within a species that can be interbred. And a novel allele is one that does not exist within a species that can be interbred. Movement of an allele interspecies means from one species of animal to another and movement intraspecies means movement between animals of the same species. Moving an allele from one breed to another by conventional breeding processes involves swapping many alleles between the breeds. Recombination during meiosis inevitably exchanges genetic loci between the breeds. In contrast, TALENs-modified livestock and other animals are free of genetic changes that result from meiotic recombination events since the cells or embryos are modified at a time when cells are exclusively mitotic. As a result, a TALEN-modified animal can easily be distinguished from an animal created by sexual reproduction.

The processes herein provide for editing the genomes of existing animals. The animal has a fixed phenotype and cloning the animal, e.g., by somatic cell cloning, effectively preserves that phenotype. Making a specific change or changes in a cellular genome during cloning allows for a known phenotype to be altered. Processes herein alternatively provide for altering a genome of an embryo that has yet to develop into an animal with fixed traits. Embryos with sound genetics may nonetheless not express all of the traits that are within the genetic potential of their genetics, i.e., animals do not always express the traits that their line is bred for. Embodiments include providing embryos having genetics known to be capable of expressing a set of traits and exposing the embryos to the TALEN (optionally without a reporter gene and/or selection marker) and screening the gestated animal for the modification and for expression of the set of traits. Accordingly, the introgression of desirable alleles into livestock can be achieved by editing the genomes of animals previously determined to be of significant genetic value by somatic cell modification and cloning, or by editing the genomes of animals prior to determining their implicit genetic value by treatment/injection of embryos. In the case of cloning, genetically superior animals could be identified and subjected to gene editing for the correction of a loss of function allele or the introgression of desirable alleles that are not already present. This approach provides for a controlled and characterized outcome at every step of the process as only cells harboring the desired changes would be cloned.

Editing could also be applied by the direct treatment of embryos. Embryos of unknown genetic merit would be treated and screening of offspring may consist of analysis for the desired change and analysis of genetic merit of the animal, e.g., analysis for the change plus analysis of various traits that the animal expresses. A beneficial aspect of this approach is it can be applied simultaneous with genetic improvement by marker assisted selection whereas cloning results in the loss of 1+ generation intervals. The efficiency of such modifications would need to be sufficiently high to offset any losses in reproductive rate engendered by embryo treatment. In the case of simple gene-inactivation, the frequency of success is very high (75%), with even homozygous modification in 10-20% of embryos (Examples 1 and 8). Embodiments include exposing embryos (or cells) to a TALEN (optionally without a reporter gene and/or without a marker gene with more than about 1% of the embryos incorporating the modification at the TALEN-targeted chromosomal site (heterozygous or homozygous); artisans will immediately appreciate that all the ranges and values within the explicitly stated ranges are contemplated, e.g., from about 1% to about 85%, or at least about 5% or at least about 10%. Cells may similarly have TALENs introduced successfully at very high efficiencies, with the same ranges being contemplated, i.e., more than about 1%. Conventional processes achieve a lower percentage. Moreover, precision genome editing can also be used to introduce alleles that do not currently exist within a species by homology-driven allelic substitution.

Introgression of POLLED Allele

To protect the welfare of dairy farm operators and cattle, horns are routinely manually removed from the majority of dairy cattle in the U.S., Europe, and in other regions. De-horning is painful, elicits a temporary elevation in animal stress, adds expense to animal production and, despite the intent of protecting animals from subsequent injury, the practice is viewed by some as inhumane. Some beef breeds are naturally horn-free (e.g., Angus), a trait referred to as POLLED that is dominant. The techniques set forth herein improve animal well-being by providing animals that do not have to undergo dehorning. Two allelic variants conferring polledness have recently been identified on chromosome 1. Dairy cows with either of these mutations are rare and generally rank much lower on the dairy genetic selection indices than their horned counterparts. Meiotic introgression of the POLLED allele into horned breeds can be accomplished by traditional crossbreeding, but the genetic merit of crossbred animals would suffer and require many lengthy generations of selective breeding to restore to productivity.

Figure 35:
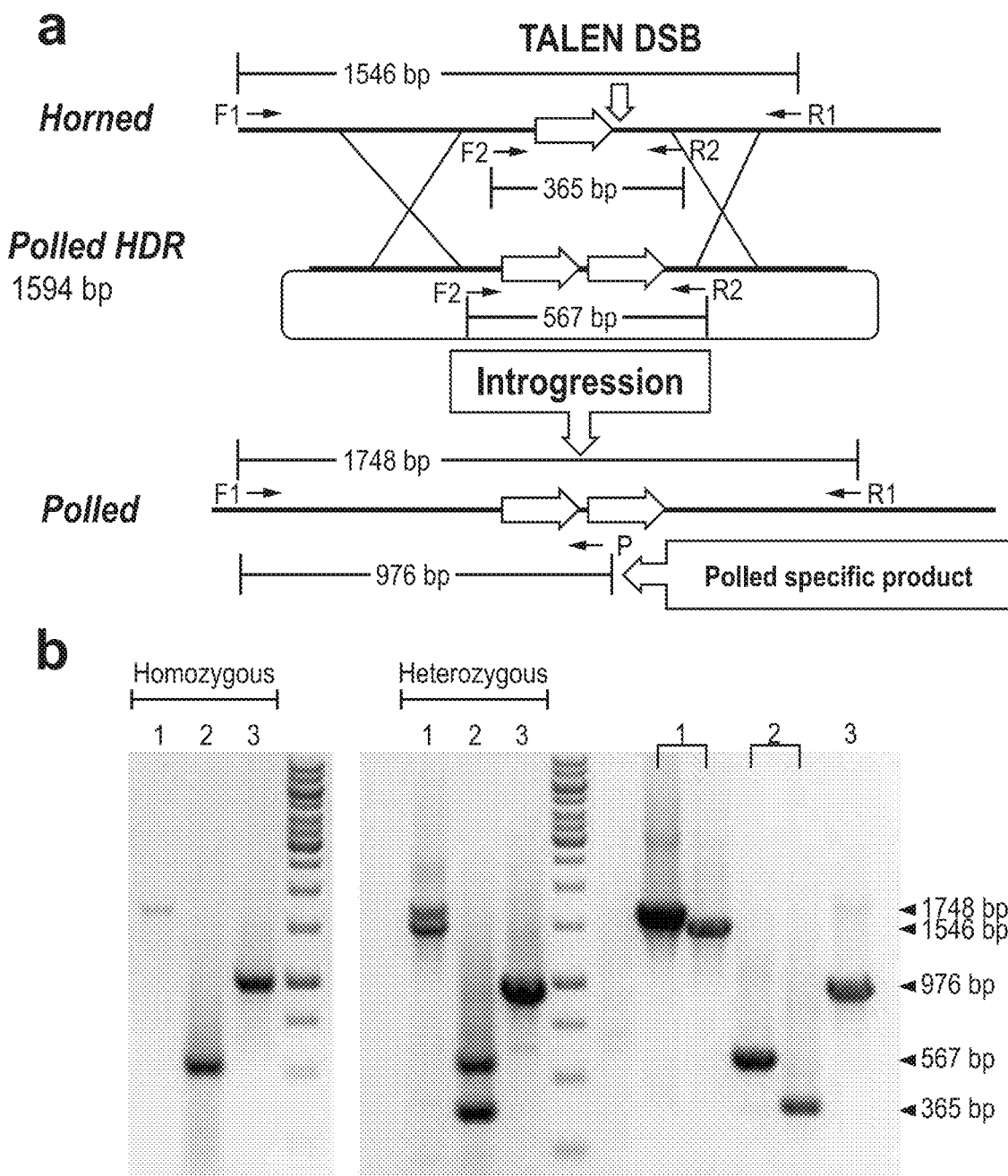
FIG. 35: TALEN-mediated introgression of POLLED. Panel a) A schematic of the strategy to introgress the Polled allele into Holstein (HORNED) cells. The POLLED allele, bottom, is a tandem repeat of 212 bp (horizontal arrow) with a 10 bp deletion (not shown). TALENs were developed to specifically target the HORNED allele (vertical arrow) which could be repaired by homologous recombination using the POLLED HDR plasmid. Panel b) Representative images of colonies with homozygous or heterozygous introgression of POLLED. Three primer sets were used for positive classification of candidate colonies: F1+R1, F2+R2 and F1+P (POLLED specific). Identity of the PCR products was confirmed by sequencing F1+R1 amplicons.

It is possible, however, to create polledness in animals, and to do so without disturbing the animals' genome. The non-meiotic introgression of the Celtic POLLED allele (duplication of 212 bp that replaces 10 bp) was achieved in fibroblasts derived from horned dairy bulls. A plasmid HDR template containing a 1594 bp fragment including the Celtic POLLED allele was taken from the Angus breed (FIG. 35 panel a and FIG. 72). TALENs were designed such that they could cleave the HORNED allele but leave the POLLED allele unaffected. Surprisingly, this experiment showed that one pair of TALENs delivered as mRNA had similar activity compared to plasmid expression cassettes (FIG. 36), Accordingly, experiments were performed that delivered TALENs as mRNA to eliminate the possible genomic integration of TALEN expression plasmids. Five of 226 colonies (2%) passed each PCR test shown in FIG. 6 panel b to confirm introgression of POLLED. Three of the five clones were homozygous for POLLED introgression and confirmed by sequencing to be 100% identical to the intended allele. U.S. Ser. No. 14/154,906 filed Jan. 14, 2014, which is hereby incorporated by reference herein, provides additional information regarding polledness.

Embodiments of the invention comprise moving a polled allele from one breed to another breed. For instance, alleles may be moved from Angus cattle to other cattle. Horned breeds include: Hereford, Shorthorn, Charolais, Limousin, Simmental, Brahman, Brangus, Wagyu, and Santa Gertrudis, Ayrshire, Brown Swiss, Canadienne, Dutch Belted, Guernsey, Holstein (Holstein-Friesian), Jersey, Kerry, Milking Devon, Milking Shorthorn, Norwegian Red, Busa, Canadienne, Estonian Red, Fleckveih, Frieian, Girolando, Illawarra, Irish Moiled, Lineback, Meuse Rhine Issel, Montbeliarede, Normande, Randall, Sahhiwal, Australian Milking Zebu, Simmental, Chianina Marchigiana, Romagnola. Some of the above listed breeds also have polled variants, but the lines in which there genetics are often inferior to the horned version. Examples of polled breeds include: Angus, Red Angus, Red Poll, Galloway, Belted Galloway, American White Park, British White, Amerifax, Jamaica Black, Jamaica Red, Murray Grey, Brangus, Red Brangus, Senopol. As set forth elsewhere herein, the site-specific endonuclease tools, e.g., TALENs, may be delivered as a protein or encoded by a nucleic acid, e.g., an mRNA or a vector.

Geneticists have hunted for the genetic locus of polledness for decades. In brief, polledness has been an object of intense modern research for twenty years. See Allais-Bonnet et al. (2013) Novel Insights into the Bovine Polled Phenotype and Horn Ontogenesis in Bovidae. PLoS ONE 8(5): e63512. The polled mutation was quickly mapped to *bovine* chromosome 1 in many breeds, but the actual site of the genetic cause of polledness was elusive for various reasons. Quite recently, however, it was shown that there are at least two polled alleles (one "Celtic" and one "Friesian") and candidate mutations were proposed for each of them. Medugorac et al. (2012) Bovine polledness—an autosomal dominant trait with allelic heterogeneity. PLoS One 7:e39477. None of these mutations were located in known coding or regulatory regions. Herein, the inventors show that making genetic changes at comparable sites in non-polled (horned) animals can result in polled phenotypes.

Two cattle alleles for polled have been identified on chromosome 1 in cattle (Medugorac, 2012). PC, Celtic origin (212 bp, 1,705,834-1,706,045 bp) is duplicated (and replaces a sequence of 10 bp (1,706,051-1,706,060 bp). Some breeds with this allele include Angus, Galloway, Fleckvieh, Gelbvieh and Murnau-Werdenfelser. A second polled allele of, PF, is of Friesian origin is characterized by the following, P5ID (replace 7 bp (CGCATCA with TTCTCAGAATAG (SEQ ID NO: 177); 1,649,163-1,649, 169) and 80,128 bp duplication (1,909,352-1,989,480 bp P80kbID, plus five point mutations at the positions (G1654405A, C1655463T, T1671849G, T1680646C, C1768587A). These changes are generally inherited as a fixed block. All chromosomal coordinates are from the UMD 3.1 cattle genome build.

The inventors show herein that the *bovine* POLLED allele was introgressed into horned Holstein fibroblasts. This example demonstrates that various breeds of dairy cattle can be created that do not have horns. And this change can be made without disturbing other genes, or other parts of the genome, of the animals. These processes have been developed by the inventors to achieve efficiencies that are so high that genetic changes can be made without reporters and/or without selection markers. Moreover, the processes can be used in the founder generation to make genetically modified animals that have only the intended change at the intended site. These methods demonstrate meiosis-free intra- and inter-specific introgression of polled and hornless alleles in livestock cells, large mammals, and livestock for research, agricultural and biomedical applications. Since the polled allele relates to the non-development of horns, embryos modified (direct injection or by cloning) to be polled are expected to successfully gestate and result in live births of healthy animals. Cells have been modified from a horned allele to a polled allele and, as of the time of filing, steps have been taken to clone animals from these cells and to generate live birthed animals.

Figure 61:
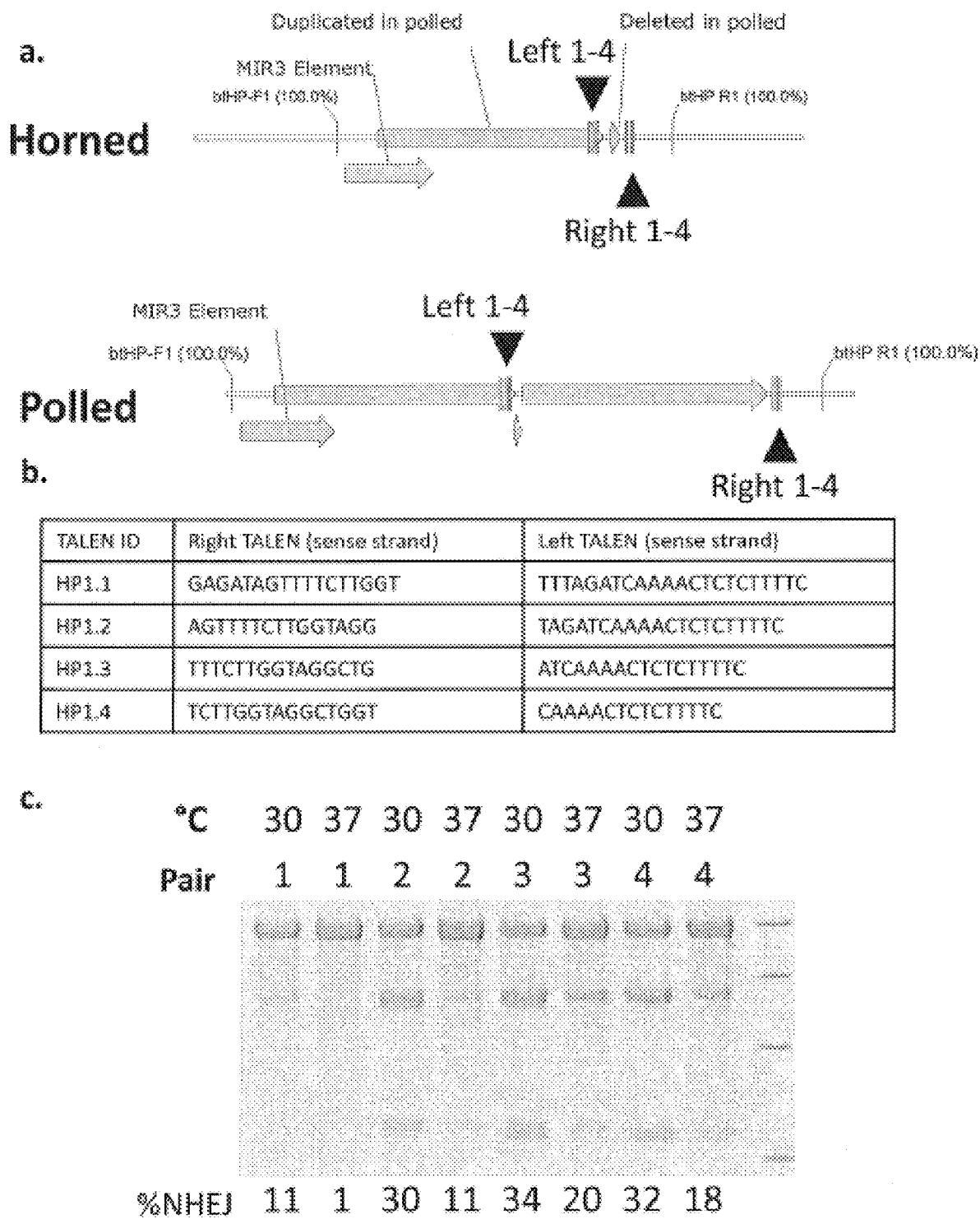
FIG. 61: Panel a) Schematic of the *bovine* horned/polled locus. TALENs were designed to cut the horned variant where indicated by arrowheads. Panel b) The sense strand sequence of four TALENs. Panel c) Surveyor assay of horned Holstein fibroblasts cells three days post transfection with mRNA encoding each TALEN pair. TALEN ID and incubation temperature post transfection are indicated above the gel. Sequence identifiers as follows: HP1.1 left and right (SEQ ID NOs: 240 and 347); HP1.2 left and right (SEQ ID NOS: 348 and 149); HP1.3 left and right (SEQ ID NOS: 150 and 151); HP1.4 left and right (SEQ ID NOS: 152 and 153).

FIG. 61 describes experiments for determining if site-specific nucleases could be made that bind to, and cleave, appropriate sites in *bovine* DNA. One of the problems was to determine if tandem repeats could be bound, bearing in mind that repeated sequences at the desired binding site can confound targeting due to the high likelihood of intermolecular recombination. Moreover, these bindings have to be efficient and mutually cooperate in a live cell in culture. The horned allele, in particular, is a challenge due to the high similarity of polled allele to the horned allele. The chosen location for TALEN binding sites was not obvious; the TALENs designs that were successful can cleave and bind the horned locus but do not allow TALENs to cleave the polled allele. Discovering these designs was an important achievement in the research of the invention. The success of this approach could not be predicted. As shown in FIG. 61, SEQ ID NOS: 146-153, the horned allele chosen as the target had 212 residues and the polled allele had a repeat of those 212 residues. The polled allele further had a 10 base pair (bp) deletion in between the repeats. Panel a) depicts the 212 bp sequence, with the 10 bp that are to be deleted at the end, in between the left TALEN (marked by a solid inverted triangle) and the right TALEN (marked by a solid triangle). The TALENs pairs were thus placed on either edge of the 10 bp deletion site. The TALENs pairs cleaved the horned allele in the area of the 10 bp deletion. A homologous dependent recombination (HDR) template was used to guide insertion of the 212 residue repeat (actually 202 residues since it is a repeat with a 10 bp deletion) between the locations where the TALENs were binding. As depicted in panel a) at Polled, the Left TALEN and Right TALEN are then separated by 202 residues. And recleavage of the polled allele is reduced. Various TALENs were made to determine if binding and cleavage could be reasonably accomplished. The table in panel b) lists some of the TALENs that were tested. Panel c) shows the test results with their effectiveness measured by the % NHEJ. The TALEN in the third lane, HP1.3, was subsequently used for introgression of polled alleles.

FIG. 62 shows the research strategy and results for introgression of a polled allele into a cell with a horned allele. The Horned allele has 1546 bp between PCR primers F1 and R1. In this sequence, there are 365 bp between PCR primers F2 and R2. The horned allele with a 212 bp sequence represented by an arrow is in this area. The POLLED allele, bottom, has a tandem repeat of the 212 bp (shown as two arrows) with a 10 bp deletion (not shown). The length between PCR primers F2 and R2 is 567 bp; the 567 bp equals the 365 bp in the horned allele plus the 212 bp repeat minus to 10 bp deletion. The length of the HDR template was 1594 bp. Once the template sequence is introgressed into the cell's chromosome, there are 1746 bp between primers F1 and R1; the 1746 equals the 1546 bp of the horned allele plus 212 bp of the repeat minus to 10 bp deletion. Further, a PCR product unique to the polled allele is indicated as P, in the tandem repeat area. TALENs were developed to specifically target the HORNED allele (FIG. 61) which could be repaired by homologous recombination using the HDR template (SEQ ID NO: 381). Cells that received the TALENs and HDR template were diluted and plated as single-cells that were cultured and allowed to replicate in clonal colonies. Members of the colonies were tested for the polled allele. Panel b shows representative images of colonies with homozygous or heterozygous introgression of POLLED. Three primer sets were used for positive classification of candidate colonies: F1+R1, F2+R2 and F1+P (POLLED specific). Identity of the PCR products was confirmed by sequencing F1+R1 amplicons.

Figure 63:
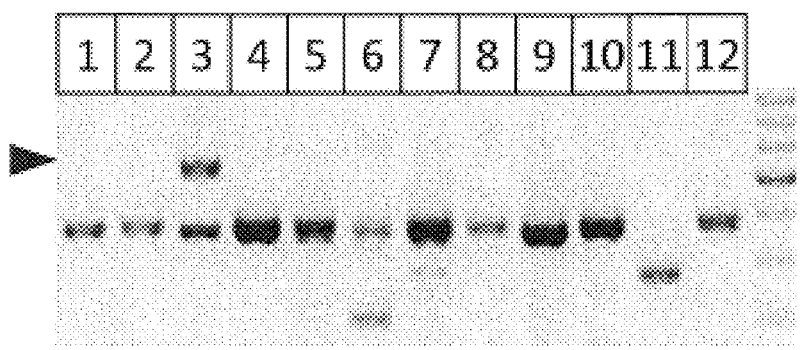
FIG. 63: Example of polled conversion in an isolated colony. Individual colonies were propagated from cell populations described in FIG. 2. Each colony was analyzed by the PCR method described in FIG. 2. Clone 3 has a product at both 389 and 591 bp (arrow) indicative of a heterozygous conversion to the polled allele. The Repair Template used was 591 residues in length.

FIG. 63 is an example of polled conversion. The polled allele was introgressed into cells in a manner similar to that described for FIGS. 1 and 2, except that a different HDR template was used. The template was 591 bp in length:

```
                                            (SEQ ID NO: 522)
GAAGGCGGCACTATCTTGATGGAACTCAGTCTCATCACCTGTGAAATGAA

GAGTACGTGGTACCAACTACTTTCTGAGCTCACGCACAGCTGGACGTCTG

CGCCTTTCTTGTTATACTGCAGATGAAAACATTTTATCAGATGTTTGCCT

AAGTATGGATTACATTTAAGATACATATTTTTCTTTCTTGTCTGAAAGTC

TTTGTAGTGAGAGCAGGCTGGAATTATGTCTGGGGTGAGATAGTTTTCTT

GGTAGGCTGTGAAATGAAGAGTACGTGGTACCAACTACTTTCTGAGCTCA

CGCACAGCTGGACGTCTGCGCCTTTCTTGTTATACTGCAGATGAAAACAT

TTTATCAGATGTTTGCCTAAGTATGGATTACATTTAAGATACATATTTTT

CTTTCTTGTCTGAAAGTCTTTGTAGTGAGAGCAGGCTGGAATTATGTCTG

GGGTGAGATAGTTTTCTTTGCTCTTTAGATCAAAACTCTCTTTTCATTTT
```

-continued
TAAGTCTATCCCAAAAGTGTGGGAGGTGTCCTTGATGTTGAATTATAGGC

AGAGGGTCAGTTTATCAACACCCAAGACCAACATCTCTGCC.

As indicated by the arrowhead, one of the 12 colonies had a PCR product that demonstrated introgression of the polled allele.

Figure 64:
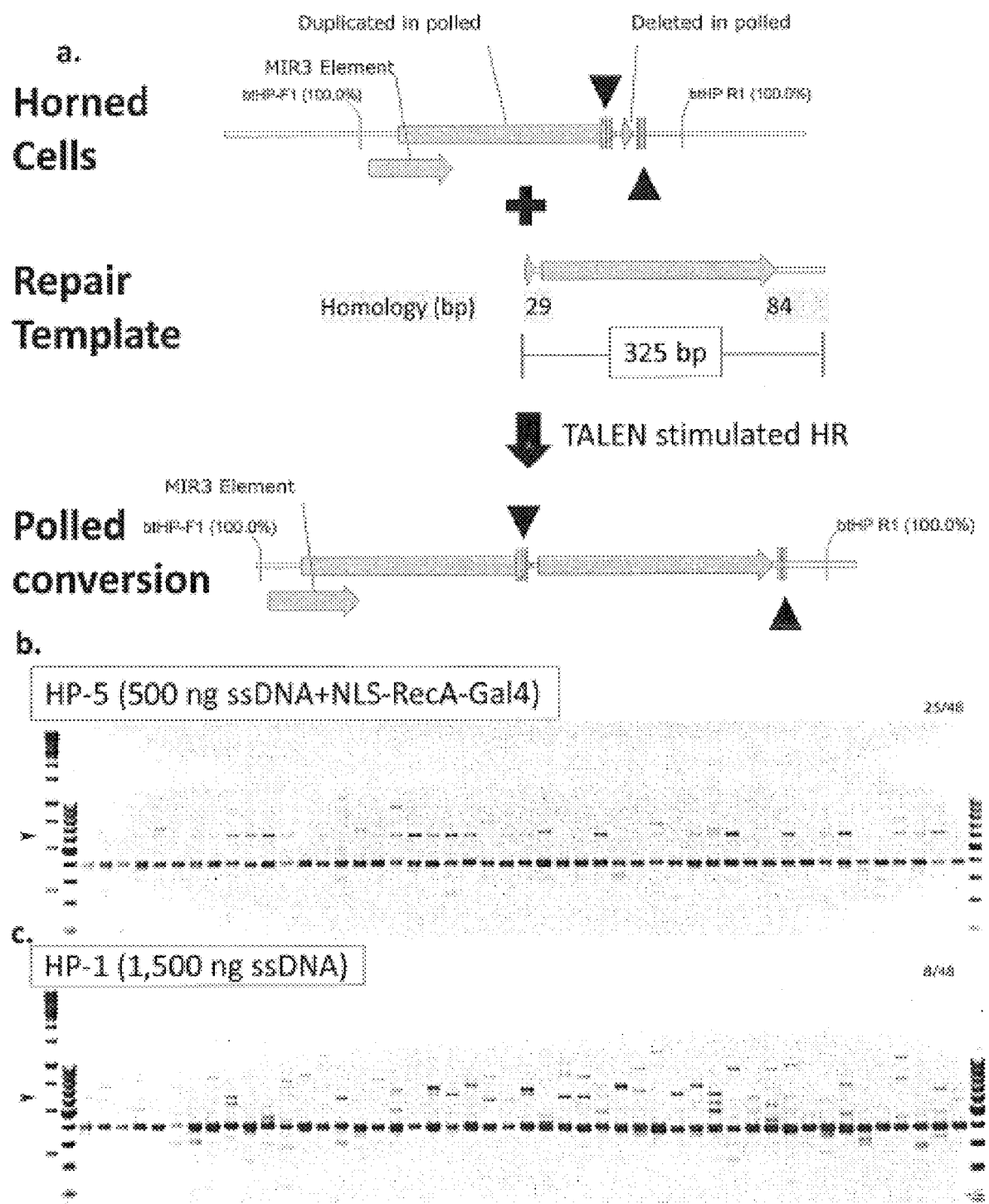
FIG. 64: Panel a) Schematic to convert a horned allele to a polled allele. HP1.3 TALENs plus a short repair template are introduced into horned cells. The repair template was generated by PCR from polled Angus genomic DNA; homology lengths are indicated. Panel b) PCR assessment of polled conversion in horned Holstein fibroblasts transfected with 2 μg of TALEN mRNA+500 ng of ssDNA coated with Gal4:RecA. Each lane/PCR reaction consists of ~3 cell equivalents diluted from a transfected population. PCR using primers btHP-F1 and btHP-R1 from horned cells results in a product of 389 bp. Conversion to polled results in a net insertion of 202 base pairs; thus the PCR product of the same primers results in a 591 bp product (arrow in left margin). The number of reactions with products indicative of polled conversion is shown in the upper right corner. Panel c) PCR assessment of polled conversion in horned Holstein fibroblasts transfected with 2 ug of TALEN mRNA+1,500 ng of ssDNA. The number of reactions with products indicative of polled conversion is shown in the upper right corner.

FIG. 64 depicts another scheme for introgression of a polled allele into a cell. A 325 bp HDR template was used:

(SEQ ID NO: 14)
5'gtctggggtgagatagttttcttggtaggctgtgaaatgaagagtacg tggtaccaactactttctgagctcacgcacagctggacgtctgcgccttt cttgttatactgcagatgaaaacattttatcagatgtttgcctaagtatg gattacatttaagatacatattttctttcttgtctgaaagtctttgtag tgagagcaggctggaattatgtctggggtgagatagttttctttgctctt tagatcaaaactctcttttcattttaagtctatcccaaaagtgtgggag gtgtccttgatgttgaattataggcag.

The introgressed allele was Red Angus polled and the recipient was horned Holstein fibroblasts. The template had 29 bp of upstream overlap and 84 bp of downstream overlap. The 212 bp repeat was in between the overlaps. The repeat was used as a replacement for the 10 bp deletion of the native 212 bp sequence. This process was similar to those described in FIGS. 1-3 except that a heat denatured (single stranded) oligomer of TALENs was used. As shown in FIG. 64, panel's b and c, there were two conditions tested. In panel b), the cells were transfected with 2 µg of TALEN mRNA+500 ng of ssDNA coated with Gal4:RecA. Each lane/PCR reaction consists of ~3 cell equivalents diluted from a transfected population. PCR using primers btHP-F1 and btHP-R1 from horn cells results in a product of 389 bp. Conversion to polled results in a net insertion of 202 base pairs; thus the PCR product of the same primers results in a 591 bp product (arrow in left margin). The number of reactions with products indicative of polled conversion is shown in the upper right corner. Panel c) PCR assessment of polled conversion in horned Holstein fibroblasts transfected with 2 ug of TALEN mRNA+1,500 ng of ssDNA. The number of reactions with products indicative of polled conversion is shown in the upper right corner.

Figure 65:
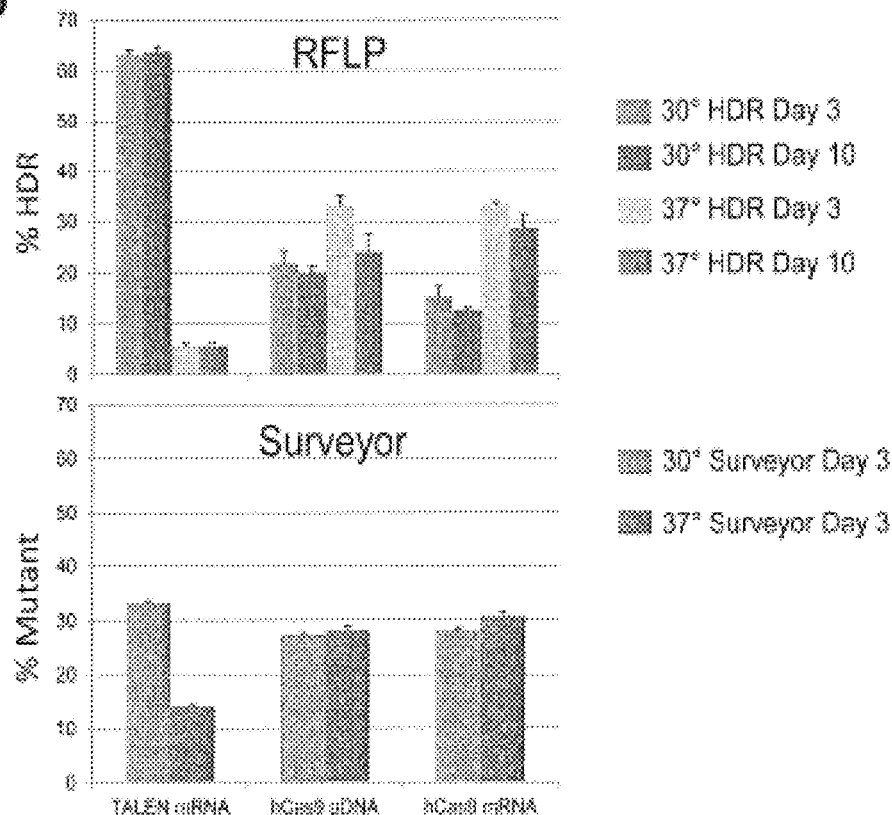
FIG. 65: Comparison of TALENs and CRISPR/Cas9 mediated HDR at porcine APC. Panel a) APC14.2 TALENs (SEQ ID NOS: 154 and 155) and the gRNA sequence APC14.2 G1a (SEQ ID NO: 157) are shown relative to the wild type APC sequence (SEQ ID NO: 156). Below, the HDR oligo (SEQ ID NO: 158) is shown which delivers a 4 bp insertion resulting in a novel HindIII site. Pig fibroblasts transfected with 2 μM of oligo HDR template, and either 1 μg TALEN mRNA, 1 μg each plasmid DNA encoding hCas9 and the gRNA expression plasmid; or 1 μg mRNA encoding hCas9 and 0.5 m of gRNA expression plasmid, were then split and cultured at either 30 or 37° C. for 3 days before expansion at 37° C. until day 10. Panel b) Charts displaying RFLP and Surveyor assay results.

FIG. 65 shows allele introgression with CRISPR/Cas9. This method is compared to a TALENs method. The introgressed allele is Adenomatous polyposis coli (APC). At panel a) the APC14.2 TALENs and the gRNA sequence APC14.2 G1a are shown relative to the wild type APC sequence. Below, the HDR oligo is shown which delivers a 4 bp insertion (see boxed section) resulting in a novel HindIII site. Pig fibroblasts transfected with 2 µM of oligo HDR template, and either 1 µg TALEN mRNA, 1 µg each plasmid DNA encoding hCas9 and the guidance RNA (gRNA) expression plasmid; or 1 µg mRNA encoding hCas9 and 0.5 m of gRNA expression plasmid, were then split and cultured at either 30 or 37° C. for 3 days before expansion at 37° C. until day 10. At panel b) the charts display RFLP and Surveyor assay results. TALEN stimulated HDR was most efficient at 30° C., while CRISPR/Cas9 mediated HDR was most effective at 37° C. For this locus, TALENs were more effective than the CRISPR/Cas9 system for stimulation of HDR despite similar DNA cutting frequency measured by Surveyor assay. In contrast to TALENs, there was little difference in HDR when hCas9 was delivered as mRNA versus plasmid.

Control of Maturation in Animals

It is desirable to produce livestock in a way that conserves environmental and energy resources. Sexually immature animals generally consume less food per pound of weight than mature or maturing animals. Livestock, in general, do not reach a desirable size before maturation. Set forth herein, however, are animals that can be grown to a desirable size before maturation.

In fact, methods are described herein whereby an animal does not sexually mature at all. It can be grown past the normal age of maturity without passing through pubescence. Sexually immature animals are sterile. The efficient production of sterile animals is therefore a significant challenge since sexual reproduction is cost effective, and even assisted reproductive techniques (ARTs) require a mature animal to provide ova and sperm. In some embodiments, the livestock animal does not pass into puberty and remains permanently sexually immature unless specifically treated to allow it to pass into sexual maturity. Such animals, after treatment to induce maturity, can then be bred.

An advantage of making livestock incapable of maturing is that they are unable to reproduce. In the case of sexually-bred or genetically modified fish, for instance, concerns about their accidental release into the wild are eliminated. Other animals that are similarly modified will also be unable to reproduce, so that animals with valuable genetic traits can be sold without concerns of uncontrolled breeding of the animals by the buyers. Further, in many farm animals (e.g., cows, poultry, and fish) sterilization will increase productivity as well as meat quality, improvements in lipid content, pigmentation and texture. The term cow is a colloquial term for cattle; cattle are large ungulates, are the most widespread species of the genus *Bos*. And, in the case of fish, sterile fish should demonstrate greater performance in culture by conserving energy for growth rather than gonad development and sexual differentiation. Currently, sterilization through ploidy manipulation (specifically triploidy, which adds of one extra set of chromosomes) is the only commercially scalable technique available to aquaculture producers. However, inconsistent results have raised concerns with respect to the efficacy of the technique. In addition, triploid induction, in general, often negatively impacts survival and/or performance of treated populations. And the application of the technology is labor intensive, logistically complicated and costly.

An embodiment of the invention is a genetically modified livestock animal comprising a genome that comprises an inactivation of a neuroendocrine gene selective for sexual maturation, with the inactivation of the gene preventing the animal from becoming sexually mature. The gene is selectively directed to sexual maturation processes and, if knocked-out of an animal, the animal will be comparable to wild-type animals in terms of its development as measured by size and weight until such time as the wild type animals undergo sexual maturation. The term gene means a locatable region of genomic sequence, corresponding to a unit of inheritance, which is associated with regulatory regions, transcribed regions, and or other functional sequence regions. The term gene, as used herein, includes the functional sequence regions as well as those portions that encode a protein or other factor. The term knocked-out, as used herein, refers to the direct or indirect disruption of a gene that either inactivates function in the resulting protein or eliminates production of the protein product.

Since the genetic modifications are directed to a specific gene or gene product to prevent sexual maturation, the factor that is needed for maturation is known and can generally be supplied.

Inducible Systems

An inducible system may be used to control expression of a sexual maturation gene. Various inducible systems are known that allow spatiotemporal control of expression of a gene. Several have been proven to be functional in vivo in transgenic animals.

An example of an inducible system is the tetracycline (tet)-on promoter system, which can be used to regulate transcription of the nucleic acid. In this system, a mutated Tet repressor (TetR) is fused to the activation domain of herpes simplex virus VP16 trans-activator protein to create a tetracycline-controlled transcriptional activator (tTA), which is regulated by tet or doxycycline (dox). In the absence of antibiotic, transcription is minimal, while in the presence of tet or dox, transcription is induced. Alternative inducible systems include the ecdysone or rapamycin systems. Ecdysone is an insect molting hormone whose production is controlled by a heterodimer of the ecdysone receptor and the product of the ultraspiracle gene (USP). Expression is induced by treatment with ecdysone or an analog of ecdysone such as muristerone A. The agent that is administered to the animal to trigger the inducible system is referred to as an induction agent.

The tetracycline-inducible system and the Cre/loxP recombinase system (either constitutive or inducible) are among the more commonly used inducible systems. The tetracycline-inducible system involves a tetracycline-controlled transactivator (tTA)/reverse tTA (rtTA). A method to use these systems in vivo involves generating two lines of genetically modified animals. One animal line expresses the activator (tTA, rtTA, or Cre recombinase) under the control of a selected promoter. Another set of transgenic animals express the acceptor, in which the expression of the gene of interest (or the gene to be modified) is under the control of the target sequence for the tTA/rtTA transactivators (or is flanked by loxP sequences). Mating the two strains of mice provides control of gene expression.

The tetracycline-dependent regulatory systems (tet systems) rely on two components, i.e., a tetracycline-controlled transactivator (tTA or rtTA) and a tTA/rtTA-dependent promoter that controls expression of a downstream cDNA, in a tetracycline-dependent manner. In the absence of tetracycline or its derivatives (such as doxycycline), tTA binds to tetO sequences, allowing transcriptional activation of the tTA-dependent promoter. However, in the presence of doxycycline, tTA cannot interact with its target and transcription does not occur. The tet system that uses tTA is termed tet-OFF, because tetracycline or doxycycline allows transcriptional down-regulation. Administration of tetracycline or its derivatives allows temporal control of transgene expression in vivo. rtTA is a variant of tTA that is not functional in the absence of doxycycline but requires the presence of the ligand for transactivation. This tet system is therefore termed tet-ON. The tet systems have been used in vivo for the inducible expression of several transgenes, encoding, e.g., reporter genes, oncogenes, or proteins involved in a signaling cascade.

The Cre/lox system uses the Cre recombinase, which catalyzes site-specific recombination by crossover between two distant Cre recognition sequences, i.e., loxP sites. A DNA sequence introduced between the two loxP sequences (termed floxed DNA) is excised by Cre-mediated recombination. Control of Cre expression in a transgenic animal, using either spatial control (with a tissue- or cell-specific promoter) or temporal control (with an inducible system), results in control of DNA excision between the two loxP sites. One application is for conditional gene inactivation (conditional knockout). Another approach is for protein over-expression, wherein a foxed stop codon is inserted between the promoter sequence and the DNA of interest. Genetically modified animals do not express the transgene until Cre is expressed, leading to excision of the foxed stop codon. This system has been applied to tissue-specific oncogenesis and controlled antigen receptor expression in B lymphocytes. Inducible Cre recombinases have also been developed. The inducible Cre recombinase is activated only by administration of an exogenous ligand. The inducible Cre recombinases are fusion proteins containing the original Cre recombinase and a specific ligand-binding domain. The functional activity of the Cre recombinase is dependent on an external ligand that is able to bind to this specific domain in the fusion protein.

Embodiments include an in vitro cell, an in vivo cell, and a genetically modified animal such as a livestock animal that comprise a neuroendocrine gene selective for sexual maturation that is under control of an inducible system. The genetic modification of an animal may be genomic or mosaic. An embodiment is a gene in the group consisting of Gpr54, Kiss1, and GnRH1 that is under control of an inducible system. The inducible system may be, for instance, selected from the group consisting of Tet-On, Tet-Off, Cre-lox, and Hif1alpha.

Neuroendocrine Genes Selective for Sexual Maturation

Sexual development of animals may be prevented by blocking neuroendocrine genes selective for sexual maturation. Sexual development, accelerated growth, and adrenal maturation is initiated when gonadotropin-releasing hormone (GnRH1) begins to be secreted by the hypothalamus. The gene GnRH1 encodes the GnRH11 precursor. In mammals, the linear decapeptide end-product is generally synthesized from a 92-amino acid preprohormone. Gonadotropin-releasing hormone (GnRH1), also known as Luteinizing-hormone-releasing hormone (LHRH) and luliberin, is responsible for the release of follicle-stimulating hormone (FSH) and luteinizing hormone (LH). GnRH1 belongs to gonadotropin-releasing hormone family. Embodiments of the invention include inactivating GnRH1 in a livestock animal. Gonadotropin-releasing hormone or analogues may be administered to the animal to bring it to sexual maturity. Sequences for GnRH1 across multiple species are well known, e.g., Gene IDs 768325 for *Bos Taurus*, 770134 for *Gallus gallus*, or 397516 for *Sus scrofa*. GPR54, also known as the Kisspeptin receptor (also referred to as GpR54, KissR, Kiss1R, kissR and the like), binds to the hormone Kisspeptin (formerly known as metastin). Kisspeptin is a product derived from the KiSS1 gene (also referred to as Kiss, Kiss1, KiSS, kiss1 and the like). Kisspeptin-GPR54 signaling has a role in initiating secretion of GnRH1. Kisspeptin is an RFamide neuropeptide with multiple functions, involving varied whole body physiological systems and acting at all levels of the reproductive axis—brain, pituitary, gonad (BPG), and accessory organs. Kisspeptin can directly stimulate GnRH release (Messager et al., 2005), relaying steroid hormone negative and positive feedback signals to GnRH neurons, serving as a gatekeeper to the onset of puberty, and relaying photoperiodic information.

Embodiments of the invention include inactivating the gene GPR54 and/or KiSS1 in a livestock animal. Kisspeptin may be administered to make-up for a loss of KiSS1 and thereby achieve sexual maturity. Or, KiSS1 and/or GPR54 is suppressed, and gonadotropin-releasing hormone may be administered to the animal to bring it to sexual maturity. Another embodiment is inactivation of the Kisspeptin-GPR54 interaction by inserting a dominant negative GPR54 into the genome of a livestock animal. Expression of the dominant negative GPR54 prevents initiation of sexual maturation. Expression of the dominant negative GPR54 interferes with signal transduction downstream of the receptor, preventing signal propagation and release of GnRH1. Sequences for GPR54 are well known across multiple species, e.g., 84634 for *Homo sapiens,* 561898 for *Danio rerio*, or 733704 for *Sus scrofa*. Sequences for Kiss1 are well known across multiple species, e.g., 615613 for *Bos taurus,* 733704 for *Sus scrofa,* or 100294562 for *Ovis aries*.

The Gpr54/Kiss pathway is highly conserved among most vertebrate species and is known to be the gatekeeper to puberty in humans and mice. (Seminara et al., 2003). Infertility due to inactivation of the Gpr54 and/or Kiss gene in humans and mice has been reverted by ectopic GnRH administration. Studies in mice and humans demonstrate that inactivation Gpr54 effectively leads to infertility of both sexes due to hypogonadotropic hypogonadism (d'Anglemont de Tassigny et al., 2007; de Roux et al., 2003). The Kiss-Gpr54 system is highly conserved in vertebrates (Tena-Sempere et al., 2012) particularly in mammals where only one Kiss and Gpr54 gene is present. Whereas multiple distinct Kiss genes have been identified in fish, the receptor Gpr54 is encoded by one gene in all but one species examined. Humans and mice with Gpr54 mutations displayed normal levels of hypothalamic GnRH suggesting Kiss/Gpr54 signaling was responsible for the release of GnRH into the blood stream (Seminara et al., 2003). This presented an opportunity to bypass Kiss/Gpr54 signaling by injection of GnRH or gonadotropins directly into Gpr54-deficient subjects. Indeed, both Gpr54-deficient humans and were responsive to GnRH injection (Seminara et al., 2003) indicating that downstream signaling components of puberty remain intact.

Direct evidence of a piscine kisspeptin role in reproductive biology publications is lacking or limited. However, administration of kiss peptide has been shown to stimulate gonadotropin gene expression in the pituitary of sexually mature female zebrafish (Kitahashi et al. 2008) and orange grouper, or secretion of LH and FSH in European sea bass (Felip et al., 2008) and goldfish. Thus, in theory, the fertility of sexually immature and sterile fish with knockouts of GPR54 and/or KiSS1 can be rescued by exogenous delivery of kisspeptin analogues (e.g., Kisspeptin 10) or gonadotropin analogues (LH or FSH). With this concept, homozygous kiss or kiss receptor knockout-broodstock can be bred in captivity if administered the corrective hormone, ensuring reversible control over fertility. The progeny from this KO-broodstock inherits the alteration. This would provide economic and environmental benefit.

Neuroendocrine genes selective for sexual maturation can be inactivated by a number of processes. Inactivation of the gene prevents expression of a functional factor encoded by the gene, such as a protein or an RNA. One kind of inactivation comprises an insertion, deletion, or substitution of one or more bases in a sequence encoding the sexual maturation factor and/or a promoter and/or an operator that is necessary for expression of the factor in the animal. The inactivation may be a knock-out of a gene. The gene may be inactivated by removal of at least a portion of the gene from a genome of the animal, alteration of the gene to prevent expression of a functional factor encoded by the gene, an interfering RNA (expressed by a gene in a genome of the animal or in a plurality of cells of the animal), or expression of a dominant negative factor by an exogenous gene.

Another system for revertible-infertility is Tac3/TacR3 (Young, J., Bouligand, J., Francou, B., Raffin-Sanson, M. L., Gaillez, S., Jeanpierre, M., Grynberg, M., Kamenicky, P., Chanson, P., Brailly-Tabard, S., et al. (2010). TAC3 and TACR3 defects cause hypothalamic congenital hypogonadotropic hypogonadism in humans. J Clin Endocrinol Metab 95, 2287-2295. As with Kiss/Gpr54, humans deficient for these genes display hypogonadotropic hypogonadism which was revertible by pulsatile GnRH treatment (Young et al., 2010). Tac and/or Tac3 may be inactivated using methods described or referenced herein.

Embodiments of the invention include methods of inactivating one or more genes selected from the group consisting of GnRH1, GPR54, KiSS1, Tac and Tac3 in animals selected from the group consisting of cattle, sheep, pigs, chickens, turkeys, goats, sheep, fish, buffalo, emu, rabbits, ungulates, avians, rodents, and livestock. The genes may be inactivated in cells and/or embryos and in animals resulting therefrom. Various methods are described herein, e.g., knocking out a gene in a cell or embryo using TALENs or Zinc Finger Nucleases, and cloning and/or implanting the cell/embryo in a surrogate to make a founder animal.

Figure 49:
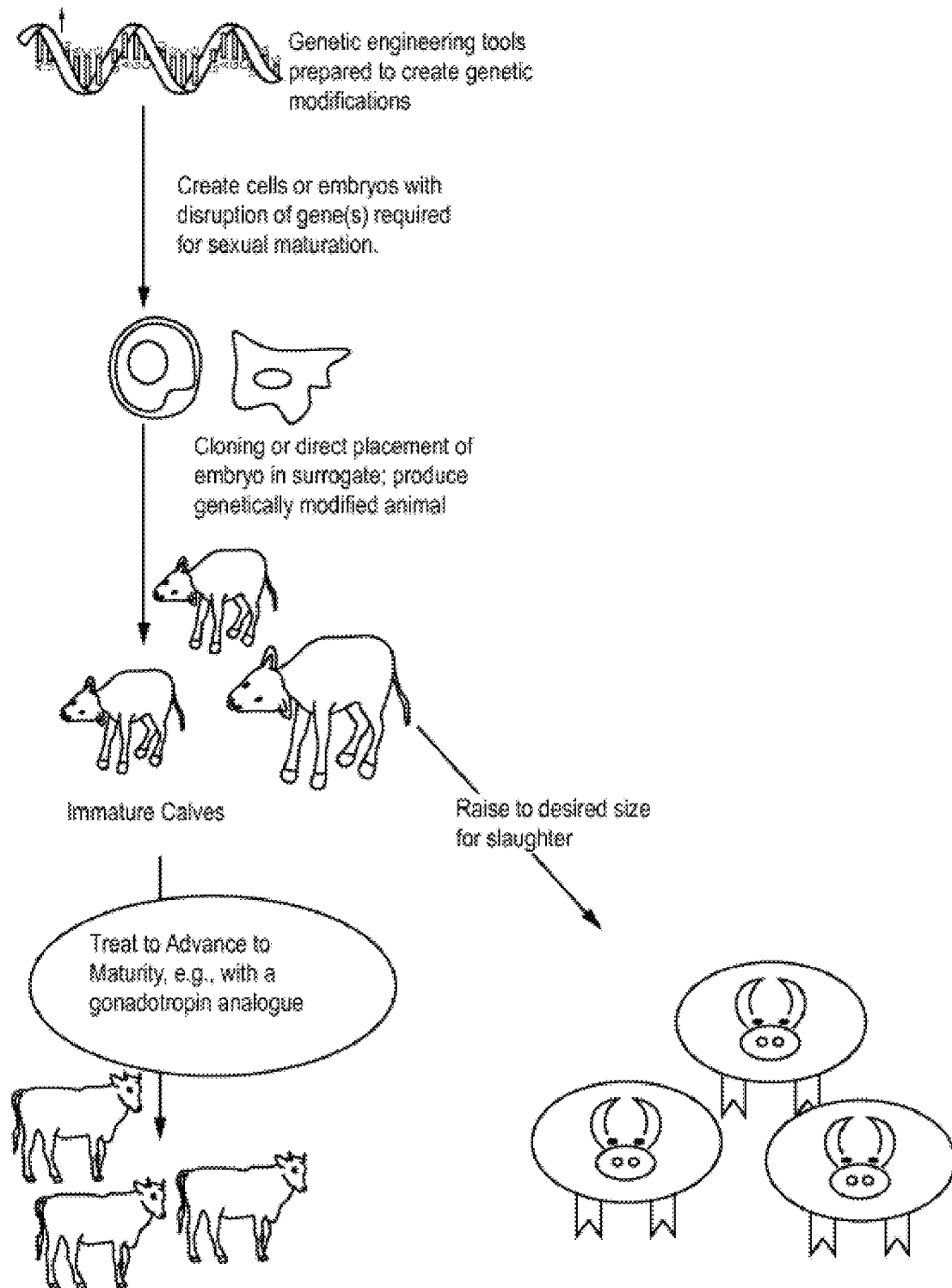
FIG. 49: An illustration of a process of making and using animals genetically modified for control of maturation.

FIG. 49 illustrates an embodiment of the invention, with *bovine* cells being modified in vitro and used to clone calves. The calves may be raised to a suitable weight for slaughter or treated with factors that allow them to pass into maturity, e.g., gonadotropin analogues or a factor that directly supplied a knocked-out genetic factor.

Example 20 describes techniques for making changes to cells with a TALEN system. Example 21 describes the dilution cloning technique used for the results of Table 7 (SEQ ID NOS: 328-335 and 464, 465). Example 22 describes the techniques of mutation detection and RFLP analysis. Example 41 (FIG. 50) describes introgression of an 11-basepair deletion into exon-3 of *bovine* GDF8 (Belgium Blue mutation)(SEQ ID NOS:428 and 431). FIG. 51 depicts results for a similar process that introgressed an allele from one species into another species. Example 42 describes testing for the same as well as introgression of alleles into cow cells using oligo HDR. In Example 42, TALEN-induced homologous recombination eliminated the need for linked selection markers. When transfected alone, the btGDF8.1 TALEN pair (SEQ ID NOS: 428 and 431) cleaved up to 16% of chromosomes at the target locus. Co-transfection with a supercoiled homologous DNA repair template harboring the 11 bp deletion resulted in a gene conversion frequency (HDR) of 0.5 to 5% at day 3 without selection for the desired event. Gene conversion was identified in 1.4% of isolated colonies that were screened by PCR, which was a rapid method to identify successful alterations. Example 43 (FIG. 52) describes the modification of four intended loci in pig and cattle fibroblasts The TALEN pairs used were ssILRG2.1 (SEQ ID NOS: 484 and 485); ssRAG2.1 (SEQ ID NOS:488 and 489); btGGTA9.1 (SEQ ID NOS:490 and 491); and ssLDLR2.1 (SEQ ID NOS:438 and 439). Example 44 (FIG. 53) shows analysis of modifications made to genes APC (SEQ ID NOS:482 and 483), LDLR (SEQ ID NOS:438 and 439), p53 (SEQ ID NOS:452 and 453), p65 (SEQ ID NOS:440 and 441), and btGDF8 (SEQ ID NOS:428 and 431). Example 45 (Table 7) shows a recovery rate for intended indels of 10-64% (average, 45%), with up to 32% of the colonies homozygous for the modification. Example 46 (FIG. 54) describes cloned pigs that were made with modified deleted in azoospermia-like (DAZL, SEQ ID NOS:

182-183) and adenomatous polyposis coli (APC, SEQ ID NOS:188-189) genes. Example 47 (FIG. 55) describes GPR54 (SEQ ID NO: 196) knockouts, made according to the indicated gene targeting strategy; Example 48 details methods for making modified animals with the GPR54 knockout. Example 49 describes modifications made with custom-made CRISPR/Cas9 endonucleases.

These results demonstrated techniques that effectively make modifications at an intended gene, without the aid of a linked selection marker. Cells with the modifications can be used for cloning animals. The intended genetic modifications can be controlled with specificity, for instance, for introgressing an allele or to modify a gene. Modifications may be, for instance, a deletion or an insertion to disrupt a gene or knock it out, or to replace part of the gene to make a nonfunctional gene product or an alternative product.

Figure 58:
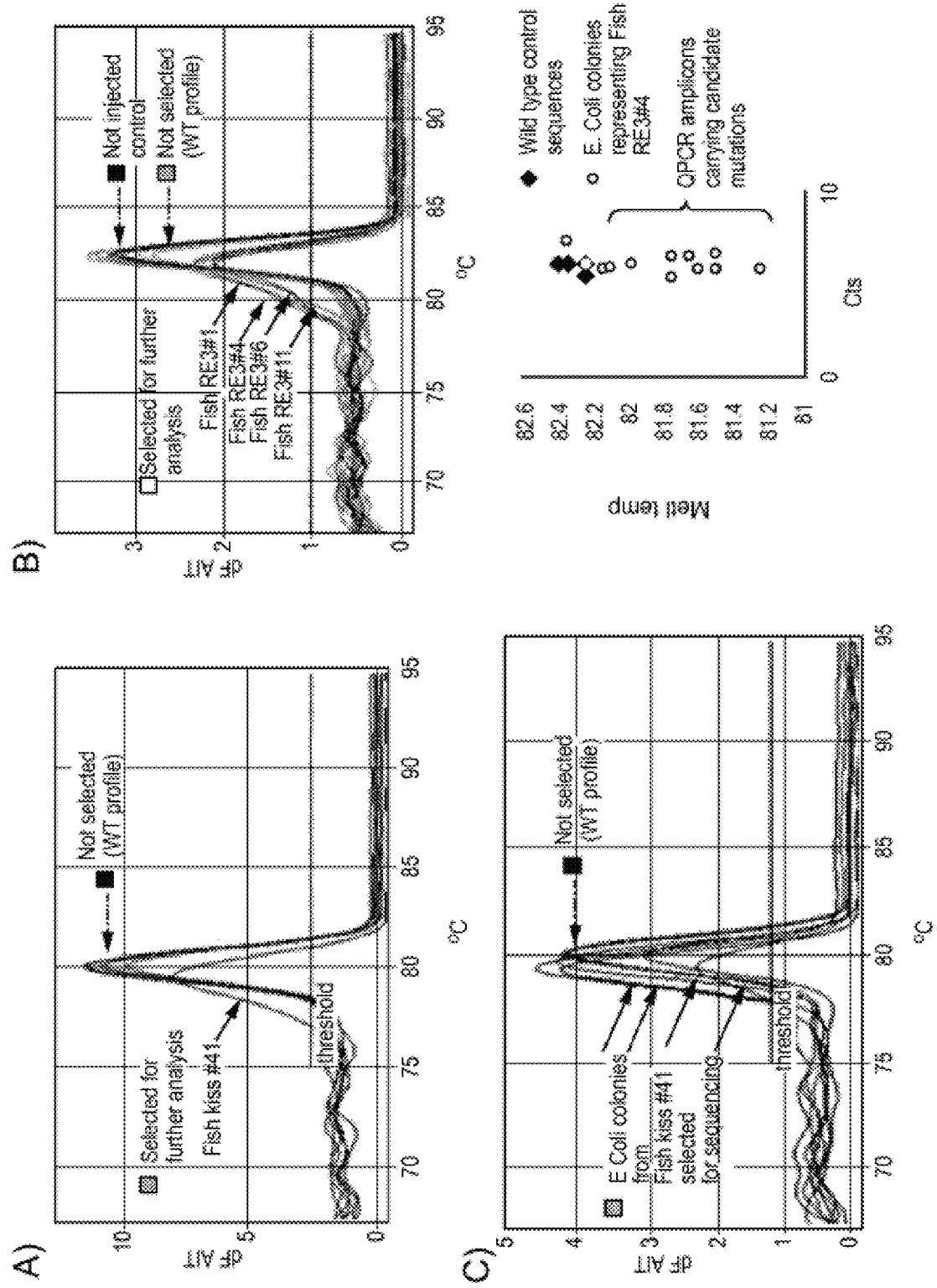
FIG. 58: Melt analysis of 100-120 bp qPCR product containing the kiss and kissRE3 loci. Panels a and b show melting curves of amplicons generated from the gDNA extracted from the fin of fish treated kiss1.1a and kissRE3 TALENs pairs. The plain arrows point to melting profiles (panel a) or (panel b) that were significantly different than those obtained from untreated fish (dotted arrows) and correspond to candidate mutant fish kiss #41, RE3 #1, 4, 6 and 11. Panel c: A 442 bp genomic segment containing the targeted Kiss loci was PCR amplified from—TALEN treated fish #41. The PCR product was cloned into TOPO 2.1 TA vector, and transformant colonies were hand-picked for direct QPCR analysis. The plain arrows point to selected melt profiles obtained from colonies containing different deletions at the kiss loci. Panel d: To better visualized the varied mutations cloned, we graphed our QPCR colony screen on a scatter plot of Cts versus melt temperature, where each clone is represented by a data plot (x, y) with x representing its Ct and y representing its melt temperature. The graph represent colonies containing the 702 bp PCR fragment amplified from Fish RE3 #4. Melt temperature below that of a wild type sequence all contained the kissRE3 amplicon with varied deletions at the target site. Cts: Cycle thresholds.
Figure 60:
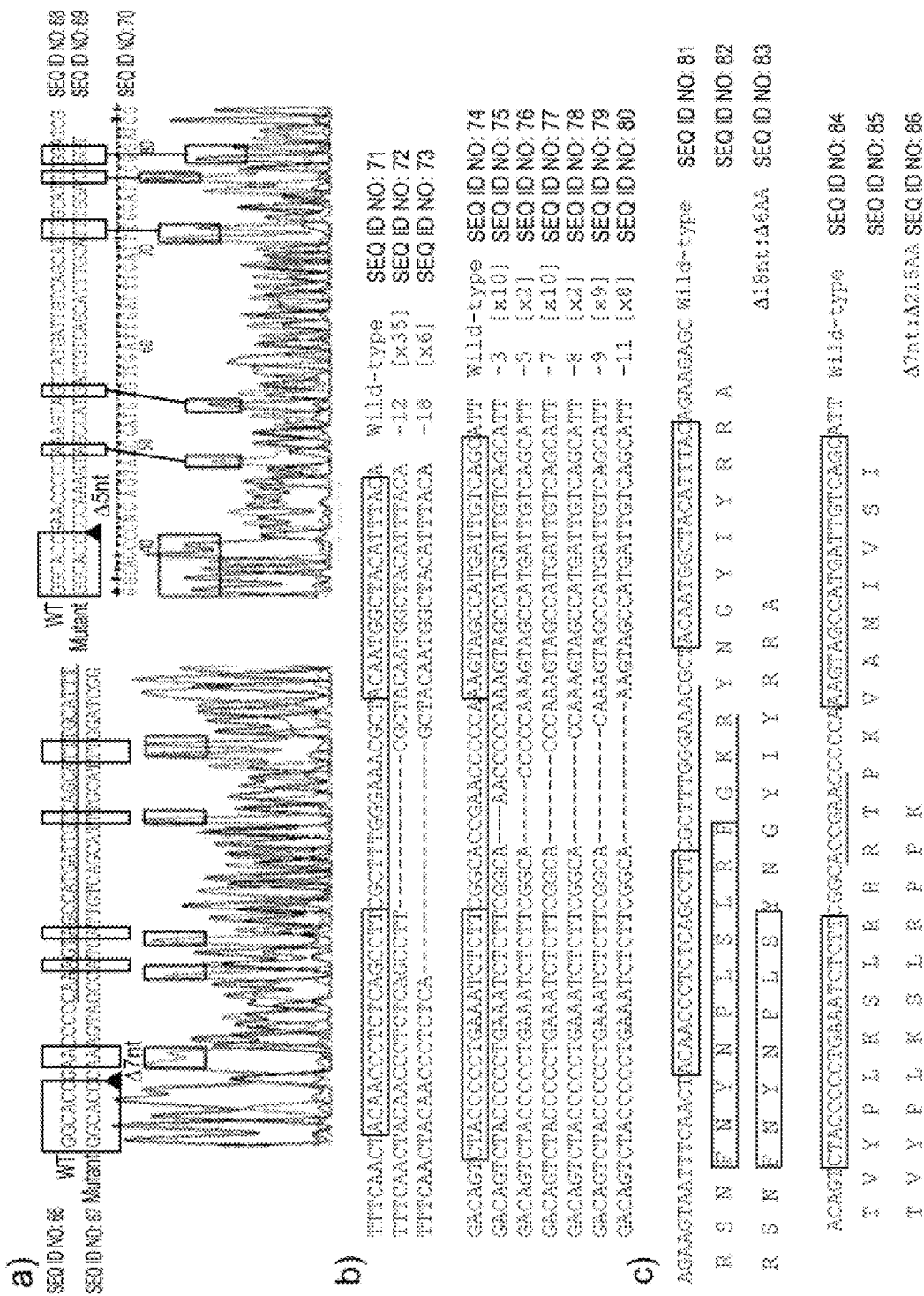
FIG. 60: Panel a: Selected sequencing chromatography of PCR products from two sibling progeny in line KissRE3 #11. These graphs indicate the presence of mutation reading simultaneously a kissRE3 mutant and a WT allele. Boxes indicate matching nucleotides on the mutant and WT alleles and arrow points to the location where sequences become divergent and thus where these deletion begin. To characterize the mutation we analyzed the pattern of unique nucleotide reads in the sequence (where the chromatograph show above background non duplicate nucleotide reads). By shifting the WT sequence and increased size deletion sequences, we found that a 7 pb and 5 bp deletions reproduce the pattern of single nucleotide reads on these chromatograph.

Fish (tilapia) with a knockout of KiSS1 and GpR54 (also referred to as GPR54, Kiss-receptor, KissR, Kiss1R) have been made. FIGS. 56 and 57 depict the targeted regions for KISS and GpR54. The structural organization of the Kiss gene is conserved and contains two coding exons, one encoding both the signal peptide and part of the kisspeptin precursor, the other encoding the remainder of the precursor including the kisspeptin-10 sequence. Example 51 details the steps that were used to make founder fish with Kiss or KissR knockouts. Techniques based on TALENs were used to knock out the genes and melt analysis was used to detect indels (FIG. 58). Various modifications at the targeted genes were confirmed (FIG. 59), including nine different nucleotide deletions, two insertions, and three combinations of nucleotide insertions and deletions. Sequencing indicated that a knockout would result from at least some of these modifications. Germ line mutations were confirmed (see FIG. 60). F1 heterozygous mutants with a Kiss or KissR knockout were created and bred. F2 generations, which are expected to show the inactivation phenotype, are presently being grown.

Disclosed herein are processes to make transgenic animals that have changes only at an intended site. Additionally, the processes can make specifically intended changes at the intended site. It is not necessary to remove other changes resulting from problems like the use of linked-reporter genes, or linked positive and negative selection genes, or random transgene integration are bypassed. Moreover, the processes can be used in the founder generation to make genetically modified animals that have only the intended change at the intended site. Other processes are also disclosed that involve unlinked marker genes and the like.

Compositions and Kits

The present invention also provides compositions and kits containing, for example, nucleic acid molecules encoding TALENs, TALEN polypeptides, compositions containing such nucleic acid molecules or polypeptides, or TALEN engineered cell lines. Such items can be used, for example, as research tools, or therapeutically.

The present invention also provides compositions and kits containing, for example, nucleic acid molecules encoding site-specific endonucleases, CRISPR, Cas9, ZNFs, TALENs, polypeptides of the same, compositions containing such nucleic acid molecules or polypeptides, or engineered cell lines. An HDR may also be provided that is effective for introgression of a polled allele. Such items can be used, for example, as research tools, or therapeutically Example 1: Genetically Modified Artiodactyl Livestock (Bovine) Produced by Direct Injection of TALENs Three TALEN pairs were designed and assembled as described in Cermak et. al. (2011) Nuc. Acids Res. 39:e82 (FIG. 3) and mRNA was injected into the cytoplasm of bovine embryos at about 19 hours post fertilization. The ACAN gene was targeted. Aggrecan Proteoglycan (ACAN) is an extracellular matrix protein that can be found in cartilagenous tissues. Mutations of the ACAN gene are known to cause dwarfism in both dogs and cattle. More particularly, bulldog dwarfism in Dexter cattle is caused by mutations in ACAN. Bulldog dwarfism in Dexter cattle is one of the earliest single-locus disorders described in animals. Affected fetuses display extreme disproportionate dwarfism, reflecting abnormal cartilage development (chondrodysplasia). Typically, they die around the seventh month of gestation, precipitating a natural abortion. Heterozygotes show a milder form of dwarfism, most noticeably having shorter legs. Homozygosity mapping in candidate regions in a small Dexter pedigree suggested aggrecan (ACAN) as the most likely candidate gene. Mutation screening revealed a 4-bp insertion in exon 11 (2266_2267insGGCA) (called BD1 for diagnostic testing) and a second, rarer transition in exon 1 (-198C>T) (called BD2) that cosegregate with the disorder. In chondrocytes from cattle heterozygous for the insertion, mutant mRNA is subject to nonsense-mediated decay, showing only 8% of normal expression. Genotyping in Dexter families throughout the world shows a one-to-one correspondence between genotype and phenotype at this locus. The heterozygous and homozygous-affected Dexter cattle could prove invaluable as a model for human disorders caused by mutations in ACAN.

Figure 3A:
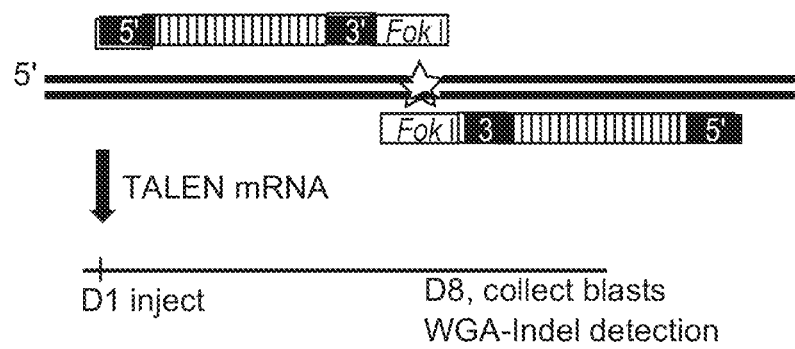
FIG. 3A: TALEN activity in *bovine* embryos. An experimental overview is given. TALENs are designed to opposing strands of the DNA target such that the FokI nuclease homodimeric monomers are able to dimerize and cleave DNA between the two monomers. Bovine in vitro-produced zygotes are injected with TALEN mRNA on day 1 (D1) and cultured in vitro to blastocyst formation. Individual blastocysts (blasts) are collected on day 8, subjected to whole genome amplification (WGA) and analyzed for indels by PCR amplification and Cel-I (SURVEYOR Nuclease, Transgenomics) treatment.
Figure 3B:
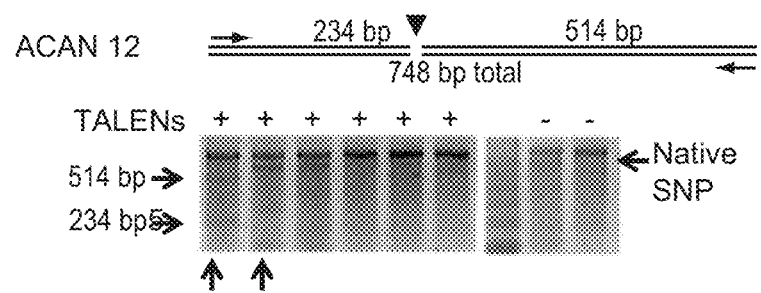
FIG. 3B: TALEN activity in *bovine* embryos. SURVEYOR Nuclease treatment for analysis of indels in *bovine* embryos mediated by ACAN12 TALENs. The amplicon length and predicted SURVEYOR cleavage products that are indicative of indels, is shown above.

Injected embryos were cultured in vitro and collected at the blastocysts stage (FIG. 3). Individual blastocyst genomic DNA was amplified by whole genome amplification (WGA) (Carlson et al. (2011) Trangenic Res. 20:29) and screened for indels using the SURVEYOR nuclease assay (FIGS. 3, 4A, and 4B). Cleavage products indicative of TALEN activity were observed in 10% of injected embryos (e.g., FIGS. 3, 4A, and 4B). Mutations in the predicted region were confirmed in 2 blastocysts injected with either ACAN11 (SEQ ID NO: 377) or ACAN12 (SEQ ID NO: 378) TALEN pairs (FIG. 3). ACAN exon 11 from *Bos taurus* breed Hereford chromosome 21 genomic scaffold targeted by btau_4.2 TALEN pairs and ACAN exon 12 from *Bos taurus* breed Hereford chromosome 21 genomic scaffold targeted by btau_4.2 were chosen. These mutations are loss of function alleles, and thus our hypothesis was that TALEN mediated KO of ACAN by targeting exons 11 (ACAN11) or 12 (ACAN12) would cause a profound and easily observed phenotype in mutant offspring. A significant decrease in the developmental competence of TALEN-injected embryos was not observed. A second round of injections was then performed using the ACAN12 TALEN pair at mRNA dosages ranging from 10-100 ng/µl. Comparison of the blastocyst formation rate between rounds 1 (33%) and 2 (5%) (10 ng/µl conditions) revealed poor embryo quality. Despite the poor quality of the embryos, 12 putative mutants (27% of injected) were identified using the SURVEYOR assay. The genotypes of each SURVEYOR positive embryo were analyzed with 14 sequencing reads from cloned PCR products. Sequencing revealed mosaicism in gene modification. Indels were identified in 4 SURVEYOR positive embryos (SEQ IDS: 2-5) and of these, indel positive sequence reads accounted for 7-29% of the total reads for each embryo, FIG. 6 and SEQ ID NOS: 28-36. Processes for the creation of animal founder lines based on embryo transfer are well known. TALEN treated embryos were successfully transferred to surrogate cows to establish pregnancies. These results demonstrated that TALENs functioned in artiodactyl embryos. Gene modification of embryos with Zinc Finger Nucleases (ZFNs) and TALENs has been reported for model organisms by direct injection of ZFN or TALEN mRNAs encoding a nuclease pair Geurts et al. (2009) Science 325:433; Carbery et al., (2010) Genetics 186:451; Mashimo et al. (2010) PLoS One 5:e8870; Tesson et al. (2011) Nature Biotechnol. 29:695. The sequence of the ACAN12 gene is found in FIG. 6 (SEQ ID NO: 26).

Example 2: Genetically Modified Artiodactyl Livestock Produced by Genetic Modification of Bovine and Swine Somatic Cells Several additional TALEN pairs were assembled as described in Cermark et al. (2011) Nuc. Acids Res. 39:e82 for targets in pigs and cattle chosen based on either biomedical or agricultural relevance, such as DMD. Mammalian animal models have proven invaluable in defining the complexity of muscle disease and have enabled the development of several promising therapeutic strategies for Duchenne Muscular Dystrophy (DMD). However, the development of regenerative therapies would greatly benefit from more faithful and reproducible models. Muscle degeneration in the mdx mouse model is mild in comparison to DMD patients, perhaps due to smaller muscle forces in rodents, or because of partial functional redundancy. Several dystrophin-deficient dogs have been identified and the causative genetic lesion defined in at least three. The best-characterized and closest in phenotype to DMD is the golden retriever muscular dystrophy (GRMD) dog caused by a splice-site mutation in Exon 6. However, the phenotype of the GRMD varies significantly with age and genetic background, confounding the utility of the dog model.

Pigs represent a socially and scientifically preferred large animal for modeling DMD. The musculoskeletal and cardiovascular physiology, myogenic program, and size of pigs is striking in its similarity to humans. Like mice, the pig genome can be efficiently manipulated to create hypomorphic and null alleles by genome engineering. We hypothesized that TALEN mediated mutation in porcine exons 7 or 8 (DMDE6; DMDE7) would produce a reliable swine mode of DMD.

Figure 5:
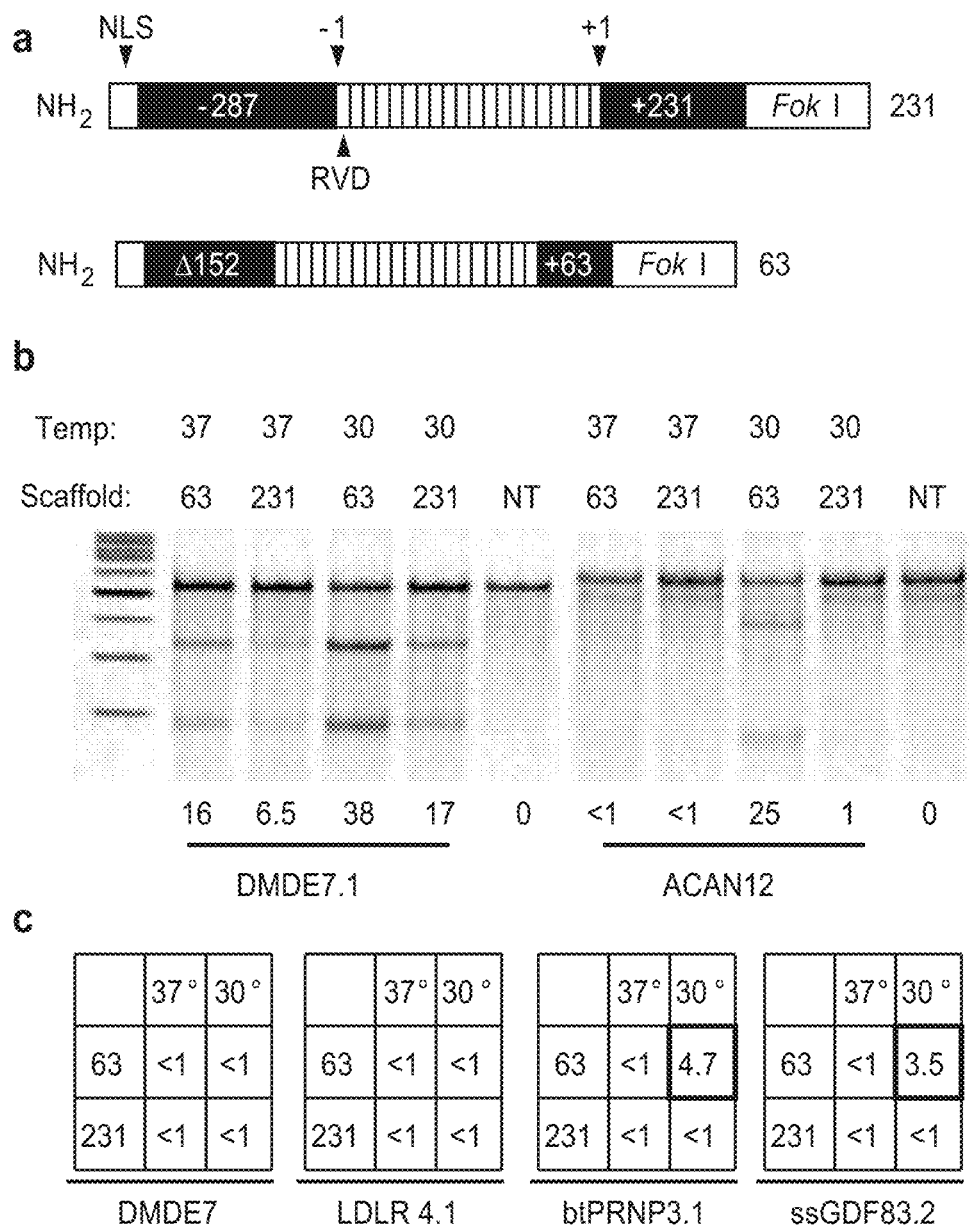
FIG. 5: Comparison of TALEN scaffold for gene editing in livestock fibroblasts. Panel a) A diagram of TALEN scaffolds tested in this experiment. Each scaffold (+231, Christian et. al. 2010 and Carlson +63, (compare to: Miller et. al. 2011)) contains a SV40 nuclear localization signal (NLS) and has a C-terminal fusion of the FokI homodimer domain. Numbering is relative to the DNA binding domain. The amino acid prior to the first repeat variable diresidue repeat (RVD) is labeled "−1" and the amino acid following the last RVD repeat is labeled "+1". Panel b) The SURVEYOR assay was conducted on fibroblasts transfected with either DMDE7.1 or ACAN12 TALEN pairs. Scaffold and temperature treatment is indicated above the gel and percent NHEJ is indicated below. Abbreviations, NT=not treated. Panel c) Activity of four additional TALEN pairs with either the +231 or Carlson +63 scaffold.

TALEN pairs DMDE6 to target DMD exon 6 (SEQ ID NO: 379) and DMDE7.1 to target DMD exon 7 (SEQ ID NO: 380) were chosen because a high percentage of Duchene's Muscular Dystrophy (DMD) is caused by gross deletions, providing the opportunity to mimic the human condition in a porcine model. Binding domains of six TALEN pairs were placed in the context of two TALEN scaffolds (+231, Christian et. al. 2010 (op cit) and Carlson +63, see Miller et. al. 2011 (op cit)) (FIG. 5). Each TALEN pair was transfected via plamid into primary livestock fibroblasts, and genome modification was measured at day 3 by the SURVEYOR assay (Guschin, et al. (2010) Methods Mol. Biol. 649:247. TALEN pair sequences are listed in Table 13 and Table 14. The most active TALEN pairs, DMDE7.1 and ACAN12, displayed cleavage of 38% and 25% of chromosomes, respectively, and Sanger sequencing revealed an assortment of indels characteristic of NHEJ mediated DNA repair (FIG. 5, FIG. 6, FIG. 9, and SEQ ID NOS: 56-58). The TALENs scaffold had a significant effect on activity in fibroblasts. In total, 4 of 6 loci targeted with the +63 isoform cleaved at 3.5% or greater while only the DMDE7.1 TALEN pair cleaved above 1% in the +231 scaffold (FIG. 5). As noted in Doyon et al. (2010) Nature Methods 8:74 and Miller, (2011) op. cit.), a 72 hour incubation at 30° C. after transfection also had a positive effect on activity, and was required for activity of 3 TALEN pairs. The success rate for generating active Carlson +63 TALEN pairs has been high. Data collected shows that 23 of 36 (64%) TALEN pairs were detectably active (>1.0% NHEJ) at 15 genes scattered across the pig and cow genome, on autosomes and both the X and Y chromosomes. Three quarters of the active pairs cleaved with high efficiency (19-40%) with an average modification level of 25%. Clonal processes for the creation of animal founder lines based on modified fibroblasts are well known. The sequence of the DIVIDE gene is found in FIG. 9A (SEQ ID NO: 55).

Example 3: Extended Culture and Indel Enrichment by Transposon Co-Transfection

TALEN pairs were transfected into fibroblasts and cultured cells for 14+ days with or without transposon co-selection prior to measurement of modification levels. The targeted genes include bovine GDF8 (btGDF8), Bovine ACAN (ACAN12), Porcine DMD (DMDE7.1 (A); DMDE6 (TALENs targeted to exon 6 of the DMD gene.)), Porcine LDLR (C) (LDLR2.1) (see Tables 13 and 14). The results are summarized in FIG. 7, panel C. At day zero (D0), cells are transfected with a mixture of plasmids including an expression cassette for each TALEN (two plasmids), a transposon encoding a selection marker (a third plasmid, encoding puromycin, and a transposase-expression cassette (fourth plasmid). The TALEN plasmids are the main component (4-fold excess by mass) of each transfection. Transfected cells are cultured for 3 days at either 30 or 37° C. prior to splitting, collection of a sample for SURVEYOR assay and re-plating for extended culture +/− selection for transposon integration. All cells are cultured at 37° C. after day 3. Cells cultured for 14+ days are collected for SURVEYOR assay and cryopreserved for downstream applications, i.e., SCNT. For comparison, other fibroblasts were transfected by nucleofection and percent NHEJ was measured at day 3, and in day 14+ non-selected (NS) and selected (S) populations. For comparison, fibroblasts were also transfected using cationic-lipids.

TABLE 2

TALEN activity in bovine zygotes

| Target | Trial | Scaffold | mRNA total ng/ul | Number Inj. | Blast rate | SURVEYOR Candidates/ assayed | NHEJ Confirmed |
| --- | --- | --- | --- | --- | --- | --- | --- |
| Non inj. | 1 | — | — | 60 | 41% | — | — |
| Buffer | 1 | — | — | 68 | 36% | — | — |
| ACAN11 | 1 | 231 | 10 | 67 | 22% | 2/24 | 1/2 |
| ACAN11 | 1 | 231 | 2 | 87 | 28% | 1/32 | 0/1 |
| ACAN12 | 1 | 231 | 10 | 57 | 33% | 0/22 | — |
| ACAN12 | 1 | 231 | 2 | 54 | 37% | 1/23 | 1/1 |

TABLE 2-continued

TALEN activity in bovine zygotes

| Target | Trial | Scaffold | mRNA total ng/ul | Number Inj. | Blast rate | SURVEYOR Candidates/assayed | NHEJ Confirmed |
|---|---|---|---|---|---|---|---|
| PRNP3.2 | 1 | 231 | 10 | 65 | 14% | 0/19 | — |
| PRNP3.2 | 1 | 231 | 2 | 50 | 30% | 0/17 | — |
| Subtotal- | | | | 380 | | 4 (3%) | 2/4 |
| | | | | | | | (1.5% assayed) |
| ACAN12 | 2 | 231 | 10 | 59 | 5% | 1/10 | 0/1 |
| ACAN12 | 2 | 231 | 25 | 58 | 16% | 3/16 | 2/3 |
| ACAN12 | 2 | 231 | 50 | 59 | 2% | 2/9 | 1/2 |
| ACAN12 | 2 | 231 | 100 | 51 | 0% | 1/10 | 1/1$^a$ |
| Subtotal- | | | | 227 | | 7 (16%) | 4/7 |
| | | | | | | | (9% assayed) |
| Non inj. | 3 | — | — | 51 | 43% | — | — |
| Buffer | 3 | — | — | 35 | 23% | — | — |
| GDF83.1 | 3 | GT | 2$^b$ | 62 | 24% | — | 6/14 |
| GDF83.1 | 3 | GT | 10$^b$ | 53 | 8% | — | 3/4$^C$ |
| Subtotal- | | | | 328 | | | 9/18 |
| | | | | | | | (50% assayed) |

$^a$3 indels in one embryo
$^b$eGFP mRNA was added to a final concentration of 2 ng/ul.
$^c$two bi-allelic modification
ACAN - Aggrecan, candidate for model of congenital achondroplasia.
PRNP - Major prion protein, implicated in spongiform encephalopathy.
GDF8 - Growth differentiation factor 8 (myostatin), regulator of muscle growth.

Example 4: Isolation of Mono- and Bi-Allelic KO Clones

Figure 8A:
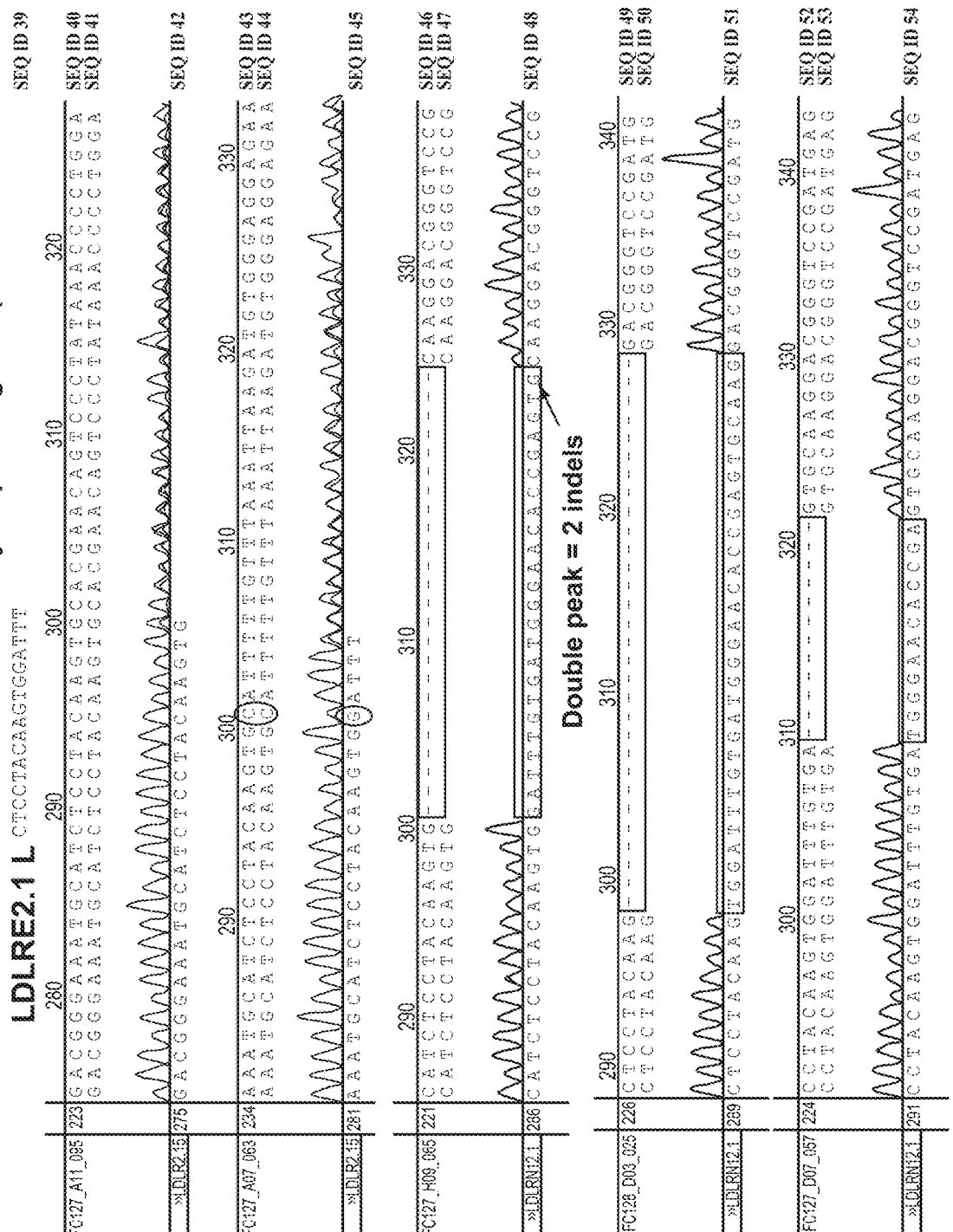
FIG. 8A: Direct PCR sequencing for identification of indels. PCR amplicons from individual fibroblast colonies were purified, sequenced and compared to the wild-type sequence SEQ ID NO: 68. Mutation of one allele or non-overlapping mutations of both alleles will result in double sequence near the TALEN recognition sites (top). Overlapping bi-allelic mutations can be identified where differences between each allele can be identified by double peaks flanking the mutation site. Colonies with homozygous mutations do not display double peaks near the indel site.

Transgenic primary fibroblasts can be effectively expanded and isolated as colonies when plated with non-transgenic fibroblasts (feeder-cells) at standard densities (>150 cells/cm2) and subjected to drug selection using the transposon co-selection technique applied above (Carlson et al. (2011) Transgenic Res. 20:1125). To evaluate this approach, puromycin-resistant colonies for cells treated with six TALEN pairs were isolated and their genotypes evaluated by SURVEYOR assay or direct sequencing of PCR products spanning the target site (FIGS. 8A and 8B). In general, the proportion of indel positive clones was similar to predictions made based on day 3 modification levels. Bi-alleic knockout clones were identified for 5 of 7 different TALEN pairs, occurring in up to 35 percent of indel positive cells (Table 1). In the majority of examples, (15 of 23), indels were homozygous (same indel on each allele) rather than unique indels on each allele suggesting that sister chromatid-templated repair is common (FIG. 9). Notably, among modified clones, the frequency of bi-alleic modification (17-60 OR35%) for the majority of TALEN pairs exceed predictions based on day 3 modification (10-17 OR15.6%) if chromosome cleavages are treated as independent events. The sequence of the LDLR gene is found in FIG. 9B (SEQ ID NO: 68). Examples of bi-alleleic sequences are further shown in FIGS. 8 and 9 using LDLR2.1 and DMDE7.1 TALENs. The sequences corresponding to the TALENs listed in table 1 can be found in Tables 13 and 14.

TABLE 1

Transposon co-selection enables isolation of modified colonies
Genotype distribution in fibroblast clones.

| TALEN pair | | Day 3 Mod | Predicted % Mod Clones | Predicted % Bi-allelic Mod | Observed Mod Clones (%) | Observed Bi-allelic Mod (%) |
|---|---|---|---|---|---|---|
| LDLRE2.1 | Pig ♂ | 19 | 34.5 | 10.5 | 30/81 (37) | 5/26 (19) |
| LDLRE2.1 | Pig ♀ | 21.5 | 38.3 | 12 | 23/76 (30) | 8/23 (35)† |
| LDLRE2.1 | Pig ♂ | 14.4 | 26.7 | 7.7 | 12/94 (13) | 2/12 (≥17)$^A$ |
| LDLRE2.1-2x$^B$ | Pig | 19.7 | 35.5 | 10.9 | 8/24 (33) | 2/8/(≥25)$^A$ |
| LDLRE4.2 | Pig ♂ | 20 | 36 | 11.1 | 4/48 (8.3) | 1/4/(25)$^A$ |
| LDLRE4.2 | Pig ♀ | 19 | 34.4 | 10 | 8/47 (17) | 0/8$^A$ |
| DMDE6 | Pig | 25 | 43.8 | 15.6 | 17/35 (49) | NA |
| DMDE7.1 | Pig | 27 | 47 | 15.6 | 12/29 (41) | 3/10 (30) |
| DMDE7.1-2x$^B$ | Pig | 22 | 39.2 | 12.4 | 22/41 (54) | 7/22 (≥32)$^A$† |
| GHRHR2.3 | Pig | 29 | 50 | 17 | 26/43 (60) | 15/26 (≥58)$^C$† |
| ACAN12 | Cow | 29 | 50 | 17 | 27/35 (77) | 2/6 (NA)$^D$ |
| btGDF83.1 | Cow | 17 | 31 | 9.3 | 7/24/(29) | 0/7 |

$^A$Bi-allelic KO were identified by sequencing of PCR products. Only overlapping or homozygous deletions can be identified using this technique.
$^B$Fibroblasts were transfected and recovered twice within two weeks with the same TALEN pair.
$^C$5/15 Bi-allelic colonies were confirmed as double frame-shift alleles.
$^D$Only colonies with distinguishable gross deletions in the PCR amplicon were analyzed.
†95% Confidence interval exceeds expected bi-allelic null hypothesis

Example 5: Chromosomal Deletions and Inversions with TALENs

Figure 10:
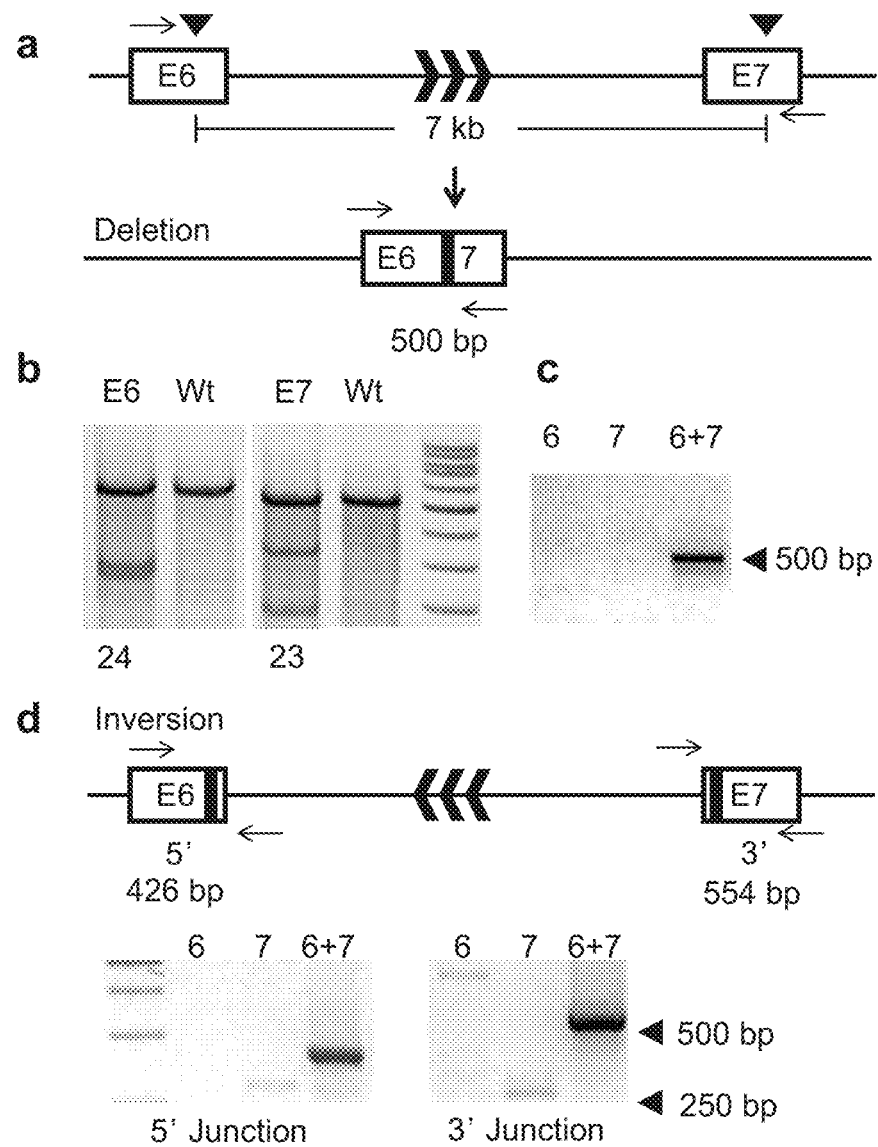
FIG. 10: TALEN-induced deletions and inversions. A schematic of the DMD locus is shown in panel (a). DNA orientation is denoted by black chevrons. TALENs targeted to exons 6 and 7 (black arrowheads) co-transfected into male pig fibroblasts could result in a NHEJ fusion event between exons 6 and 7. This could be identified using primers (black arrows) resulting in ~500 bp amplicon. Panel b) SURVEYOR assay of cells transfected simultaneously with TALENs targeted to exons 6 and 7 reveal NHEJ indels at both sites. Percent NHEJ is displayed below. Panel c) PCR with primers flanking the presumptive deletion site yield a ~500 basepair product when both exon-6 and exon-7 TALENs are introduced simultaneously, but not when transfected singly. Panel d) The predicted outcome of an inversion event of the sequence between the TALEN target sites is shown. DNA orientation is denoted by black chevrons. Primers outside the presumptive flanking sites at the 5' and 3' end of the inversion locus are shown (black arrows) along with predicted product size. PCR products were observed at both 5' and 3' junctions only when both exon-6 and exon-7 TALENs are introduced simultaneously.

It was hypothesized that simultaneous delivery of two TALEN pairs targeting the same chromosome could induce large chromosomal deletions. These were achieved and, further, large inversions were incidentally discovered. The TALEN pairs, DMDE6 (SEQ ID NOS:434 and 437) and DMDE7.1 (SEQ ID NOS:408-411) were tested because of their high activity and the fact that a high percentage of Duchene's Muscular Dystrophy is caused by gross deletions (Blake, 2002) such that a porcine model would match to the human condition. The results are summarized in FIG. 10. Day 3 gene modification levels were high for each TALEN pair (24% for DMDE6 and 23% DMDE7.1), albeit slightly lower that when either TALEN pair was transfected individually (FIG. 10). To determine if the sequence between the two TALEN pairs had been deleted, PCR was attempted with primers spanning the TALEN target sites. If the 6.5 kb sequence had been removed, a band of ~500 bp was expected, whereas the wild type band of 7 kb would not be amplified with the PCR conditions chosen. A band near 500 bp was observed in replicates where both TALEN pairs were introduced, but was absent when either TALEN pair was introduced alone (FIG. 10). The sequence of the DMD gene is found in FIG. 9A (SEQ ID NO: 61).

Next, the cell population was assayed for inversion events by PCR across presumptive new 5' and 3' junctions. Products were observed at the expected size for both the 5' and 3' junctions of the presumptive inversion only when both TALEN pairs were introduced (FIG. 10). To validate further that the inversions, colonies were generated using the transposon co-selection strategy and screened for deletion and inversion events. Both deletion and inversion events were recovered with high frequency (10.3% and 4.1% respectively; n>1000) (Table S4). Deletion and inversion events occurred with remarkable fidelity. Forty one out of 43 of the inversion positive colonies were positive at both the 5' and 3' junctions. Finally, sequencing of PCR products confirmed both deletion and inversion events with addition or deletion of very few nucleotides at their junctions (FIG. 11, 12).

Figure 13:
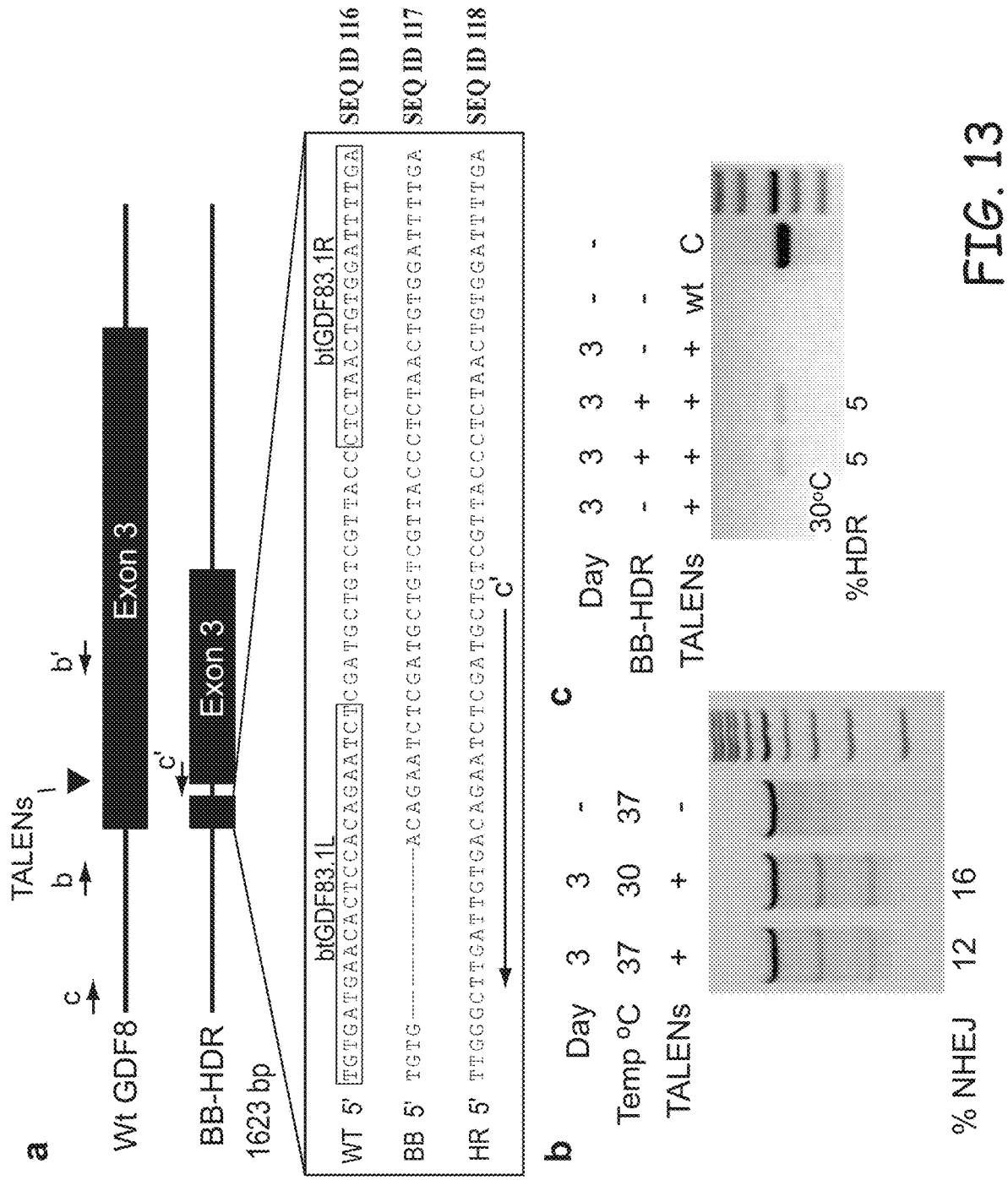
FIG. 13: HDR induction in *bovine* fibroblasts. Panel a) TALENs (btGDF83.1, arrow) and a dsDNA template (BB-HDR) were designed to introduce an 11-basepair deletion into exon-3 of *bovine* GDF8 (Belgium Blue mutation) by Double-Strand Break-induced homologous recombination. Half of the binding site for the left TALEN is missing in the BB-HDR template and thus should be resistant to TALEN cleavage. Panel b) SURVEYOR assay demonstrates activity of btGDF83.1 TALENs at both 37 and 30° Celsius. The PCR product used for this assay was generated using primers b and b' (shown in panel a). The BB-HDR template was not included in these replicates since it would confound estimates of btGDF83.1 activity. Panel c) Allele-specific PCR demonstrates that HDR induction is dependent on co-transfection of TALENs and the BB-HDR template. The PCR assay was developed to specifically detect HDR modified GDF8 alleles using primers c and c' (shown panel a). The 3' end of primer c' spans the 11-basepair deletion, and cannot amplify the wild type allele (wt). Five hundred cell equivalents were included in each PCR reaction including the positive control "C". Percent HDR was determined by comparative densitometry between experimental and control reactions.
Figure 14:
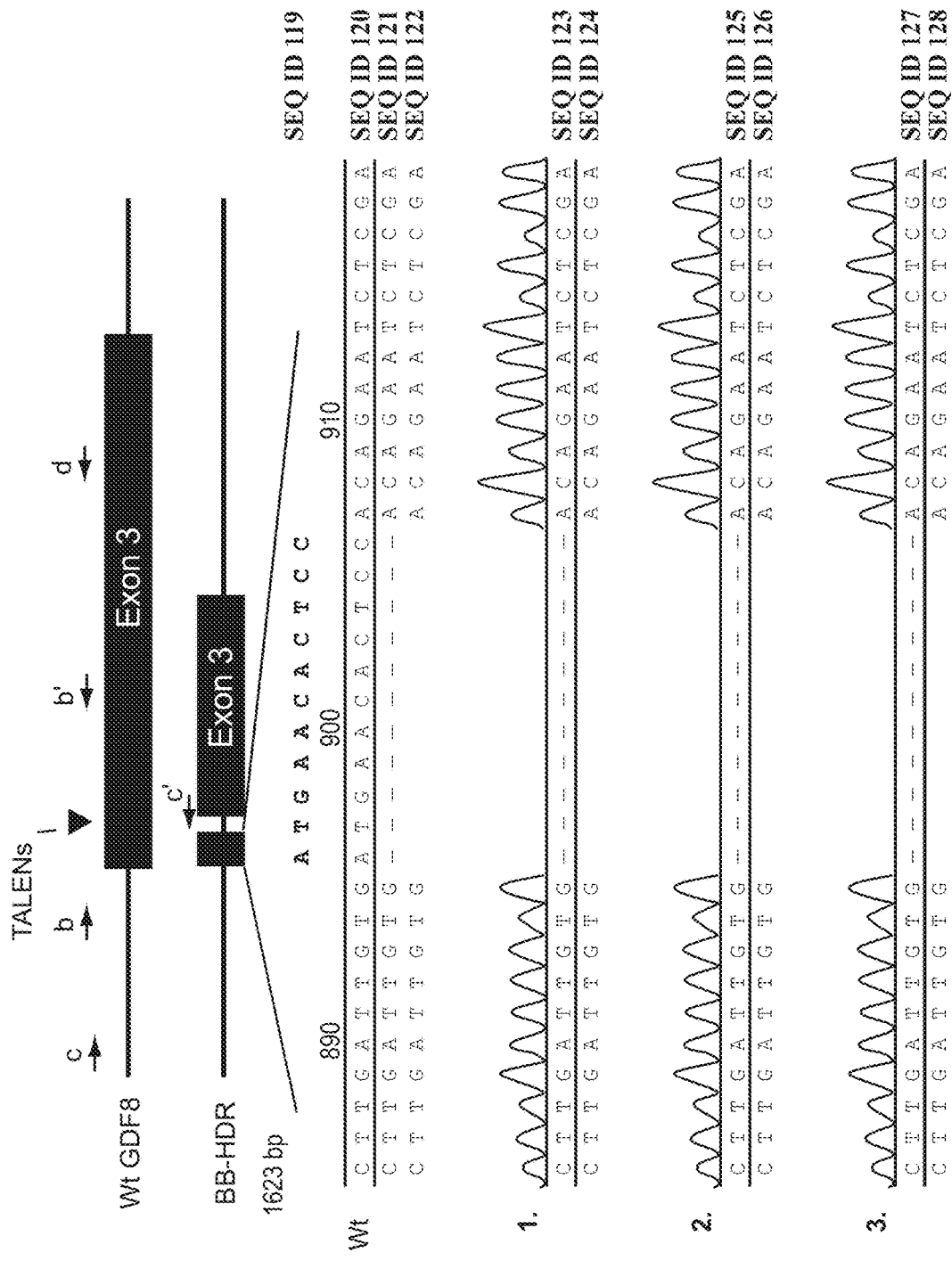
FIG. 14: Confirmation of Belgian Blue introgression by sequencing. The schematics of Wagyu wild-type GDF8 (HDR Templates for GDF8 are SEQ ID NOs. 351-353) and the Belgian Blue template (BB-HDR) are shown. PCR was conducted using primers located outside of the homology arms (c and d) on five PCR positive colonies followed by cloning and sequencing with primer b'. Comparison to the wild-type sequence reveals the expected 11-basepair deletion characteristic the Belgian Blue allele (heterozygous) in 4 of 5 colonies.

Example 6: TALEN-Induced Homologous Recombination Eliminates Need for Linked Selection Markers A mutant myostatin allele (an 11 bp deletion) from Belgian Blue cattle was placed into the genome of wild-type Wagyu cattle (Grobet et al. (1997) Nature Genet. 17:71) (FIG. 13). When transfected alone, the btGDF8.1 TALEN pair (SEQ ID NOS: 428 and 431) cleaved up to 16% of chromosomes at the target locus (FIG. 13). TALENs (btGDF83.1, SEQ ID NOS:428 and 431) and a dsDNA template (BB-HDR) (SEQ ID NO: 504) were designed to introduce an 11-bp deletion in exon-3 of *bovine* GDF8 (Belgium Blue mutation) by DSB induced homologous recombination. Half of the binding site for the left TALEN was missing in the BB-HDR template, to make it resistant to TALEN cleavage. A SURVEYOR assay demonstrated activity of btGDF83.1 TALENs at both 37 and 30° C. The PCR product used for this assay was generated using primers b and b' (shown panel A of FIG. 13). The BB-HDR template was not included in these replicates since it would confound estimates of btGDF83.1 activity. Allele specific PCR demonstrated that HDR induction was dependent on co-transfection of TALENs and the BB-HDR template. The PCR assay was developed to specifically detect HDR modified GDF8 alleles using primers c and c' (shown panel a of FIG. 13). The 3' end of primer c' spanned the 11-bp deletion, and cannot amplify the wild type allele "wt". Five hundred cell equivalents were included in each PCR reaction including the positive control "C". Percent HDR was determined by comparative densitometry between experimental and control reactions. Co-transfection with a supercoiled DNA template harboring a 1623 bp DNA fragment from Belgian Blue cattle resulted in a gene conversion frequency (HDR) of 0.5% to 5% as suggested by semi-quantitative PCR at day 3, without selection for the desired event (FIG. 13). These results demonstrated that TALENs can be used to effectively place exogenous nucleic acid sequences in livestock, including alleles—and without markers. To assess the frequency of placement in individual colonies, the transposon co-selection strategy was implemented to isolate and expand individual colonies for DNA sequencing. Gene conversion using template from Belgian Blue cattle was detected in 5 colonies out of 366 examined by PCR. Amplification with primers outside the Belgian Blue HDR template and sequencing confirmed the presence of the expected 11 bp deletion in 4 of the colonies (FIG. 14). A second repeat experiment was performed with consistent results, with about 1% of all tested colonies being positive for bi-allelic conversion and about 0.5% to about 1% of all tested colonies being heterozygous for allele conversion.

Figure 15:
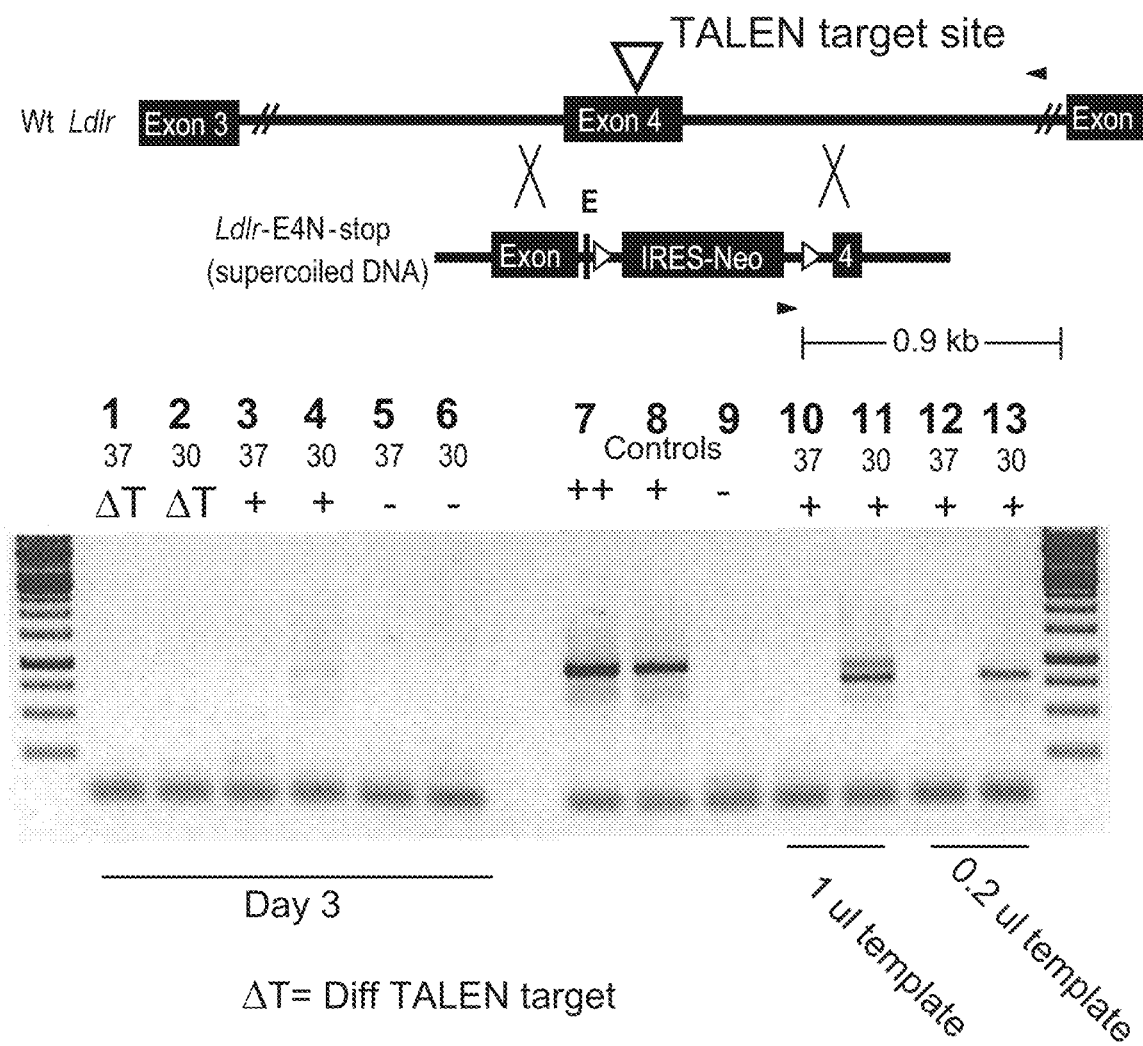
FIG. 15: Schematic and gel for TALEN-mediated HDR. A TALEN pair (LDLR2.1) targeted to the fourth exon of the swine low density lipoprotein receptor (LDLR) gene was co-transfected with the supercoiled plasmid Ldlr-E4N-stop, which contains homology arms corresponding to the swine LDLR gene and a gene-trap enabling expression of Neomycin phosphotransferase upon HDR.

Example 7: TALEN Mediated DNA Cleavage as a Target for HDR in Livestock Cells TALEN pair LDLR2.1 (SEQ ID NO: 438 and 439) targeted to the fourth exon of the swine low density lipoprotein receptor (LDLR) gene (SEQ ID NO: 349) was co-transfected with the supercoiled plasmid Ldlr-E4N-stop (Table 12, SEQ ID NO: 350) (designed to insert a stop codon into exon 4), which contains homology arms corresponding to the swine LDLR gene and a gene-trap enabling expression of Neomycin phosphotransferase upon HDR (FIG. 15). After 3 days of culture PCR analysis revealed that, even without antibiotic selection, a band corresponding to an HDR event can be detected at the targeted locus (lane 4) at 30° C. Selection of populations of cultured cells for 14 days with geneticin (G418) resulted in significant enrichment of HDR cells (lanes 11 & 13). Cloning of such modified cells by somatic cell nuclear transfer was performed, with surrogate sows presently gestating the embryos.

TABLE 12

Description of sequence of the LDLR-E4N stop plasmid

| Name | Type | Mini . . . | Maximum | Len . . . |
|---|---|---|---|---|
| 5' Homology Arm | misc_feat . . . | 5,523 | 257 | 899 |
| left ITR | LTR | 5,374 | 5,514 | 141 |
| pUC origin | misc_feat . . . | 4,701 | 5,368 | 668 |
| Amp resistance | CDS | 3,693 | 4,550 | 858 |
| f1 ori | misc_feat . . . | 2,868 | 3,174 | 307 |
| Right ITR | LTR | 2,636 | 2,776 | 141 |
| 3' Homology Arm | misc_feat . . . | 2,330 | 2,627 | 298 |
| Lox P | misc_bindi . . . | 2,283 | 2,316 | 34 |
| Neo | CDS | 1,186 | 1,977 | 792 |
| ECMV IRES | misc_feat . . . | 576 | 1,185 | 610 |
| Exon | C_region | 504 | 566 | 63 |
| BPSA | splicing si . . . | 401 | 506 | 106 |
| Lox P | misc_bindi . . . | 330 | 363 | 34 |

Example 8: TALEN Activity in Bovine Zygotes

This Example compares results obtained with the Carlson +63 TALENS to a +231 scaffold. The methods described in Example 1 were followed. Table 2 summarizes the results using the GDF83.1 TALEN pair (SEQ ID NOS: 428 and 431) targeted to exon 3 of the *bovine* GDF8 locus, with the GDF83.1 being based on the Carlson +63 scaffold. Mutation frequency using the CARLSON +63 TALENs significantly exceeded previous injections. Six of 14 blastocysts (43%) injected with a low mRNA dosage (2 ng/µl) displayed indels without a significant reduction in development rate. Three of four blastocysts in the high dosage group (10 ng/µl) displayed indels, with bi-allelic modification occurring in 2 of 3 mutant blastocysts (Table 3).

TABLE 3

Indels for GDF83.1 Bi-allelic Modification

| SEQ ID NOS | | SEQUENCES |
|---|---|---|
| 147 | Wt. | ACTCCACAGAATCTCGATGCTGTCGTTACCCTCTAACTGTGGATT |
| 148 | 1a. | ACTCCACAGAATCTCGATGCT:::GTTACCCTCTAACTGTGGATTX9 |
| 135 | 1b. | ACTCCACAGAATCTCGATG:::::::::::CTCTAACTGTGGATTX2 |
| 136 | 1c. | ACTCCACAGAATCTCGATGC::::::TACCCTCTAACTGTGGATTX1 |
| 137 | 2a. | ACTCCACAGAAT:::::::::::::::CCTCTAACTGTGGATTX3 |
| 138 | 2b. | ACTCCACAGAATCTCGATGCT:::GTTACCTCTAACTGTGGATT X1 |
| 139 | 2c. | ACTCCACAGAATCTCGATGCT:TCGTTACCCTCTAACTGTGGATTX2 2/9 Bi-allelic |

Example 9: Cloning of TALEN-Modified Cells

Cells from Example 4 that were modified with LDLR2 TALEN pairs (SEQ ID NOS:438 and 439) were grown as clones. Transposon co-selected Ossabaw swine colonies with mono- and bi-allelic modification of the Class A domain 1 of the LDLR gene were pooled disproportionately (pools A—4 genotypes, B—3 genotypes and C—5 genotypes) and cloned by chromatin transfer. Pregnancy was established in 7/9 transfers (½ for pool A, ⅔ for pool B, and 4/4 for pool C). Seven of the 9 sows became pregnant, and 6 of the 7 pregnant sows had live births. 17 piglets were born that appear to be in good health for purposes of raising to maturity. The piglets had various genotypes, referred to as B1, B2, C1 and C2 in Table 4, below. Two of the genotypes were deletions, one was a single base insertion and one genotype had modifications of both alleles, an insertion in one allele and deletion in the other.

TABLE 4

SEQ ID NOS. 141-145

| SEQ ID NO | | SEQUENCE |
|---|---|---|
| 140 | Wt: | CTCCTACAAGTGGATTGTGATGGGAACACCGAGTGCAAGGACGGGTCCG |
| | B1: | (289_290INS34; 285_287delATG) 10 born; 9 live |
| 141 | 1. | CTCCTACAAGTGGATTTGTGATGGGA_i34_ACACCGAGTGCAAGGACGGGTCCG |
| 142 | 2. | CTCCTACAAGTGGATTTGTG:::GGAACACCGAGTGCAAGGACGGGTCCG |
| | B2: | (211_292del128) One stillborn |
| 143 | 1. | AGGGAGTATGGTCAC:::::::Δ128::ACCGAGTGCAAGGACGGGTCCG |
| | C1: | (289_290del10) 3 born (one stillborn, one euthanized due to clone defects) |
| 144 | 1. | CTCCTACAAGTGGATTTGTGATGGG:::::::::GCAAGGACGGGTCCG |
| | C2: | (289_290insA) 8 born; 8 live |
| 145 | 1. | CTCCTACAAGTGGATTTGTGATGGGAAACACCGAGTGCAAGGACGGGTCCG |

Example 10: An Adeno-Associated Virus (AAV) is an Effective Template for TALEN Stimulated Homologous Recombination (HR)

In another study, similar to Example 6, a mutant myostatin allele (11 bp deletion) from Belgian Blue cattle was introgressed into the genome of wild-type Wagyu cattle (Grobet, 1997, Kambadur, 1997) (FIG. 18). Four micrograms of TALEN encoding plasmids (SEQ ID NOS: 428 and 431) were transfected into Wagyu cells and 24 hours later an adeno-associated virus (AAV-BB-HDR) harboring a 1,623 bp DNA fragment from Belgian Blue cattle was added. (SEQ ID NO: 505) Semi-quantitative PCR at day three suggests an allele conversion frequency of up to 5% only when both GDF8 TALENs and the AAV vector were added. To assess the frequency of introgression in individual colonies, the transposon co-selection strategy was implemented to isolate and expand individual colonies for DNA sequencing. Thirteen percent of isolated colonies were PCR positive for introgression of the BB allele. These results demonstrate that TALENs and an AAV homologous recombination template is an effective method for targeted allele introgression in livestock and represents a significant improvement over supercoiled plasmid homologous recombination template for the same locus (Example 6).

Example 11: Single Stranded DNA for Templating

FIG. 19 summarizes the results of the transfection of TALEN encoding plasmids, containing an 11 base pair Belgian Blue cattle mutation, into Wagyu cells. Single stranded oligodeoxynucleotides (ssODNs) were found to be an effective template for TALEN stimulated HR. The same loci as above (Examples 6 and 10) were targeted to introgress the 11 base pair Belgian Blue cattle mutation into Wagyu cells. Two 76 base pair ssODNs (SEQ ID NOS: 501 and 502) were designed to mimic either the sense or antisense strand of the BB GDF8 gene including the 11 base pair deletion. Four micrograms of TALEN encoding plasmids were transfected into Wagyu cells, and 0.3 nMol of ssODNs were either co-transfected with TALENS (N) or delivered 24 hours after TALEN nucleofection by either MirusLT1 (M) reagent or Lipofectamine LTX reagent (L). Semi-quantitative PCR at day three suggests an allele conversion frequency of up to 5% in conditions where ssODNs were delivered with LIPOFECTAMINE LTX reagent 24 hours after TALEN transfection. No difference in PCR signal was observed between sense and antisense ssODNs designed against the target.

Figure 20:
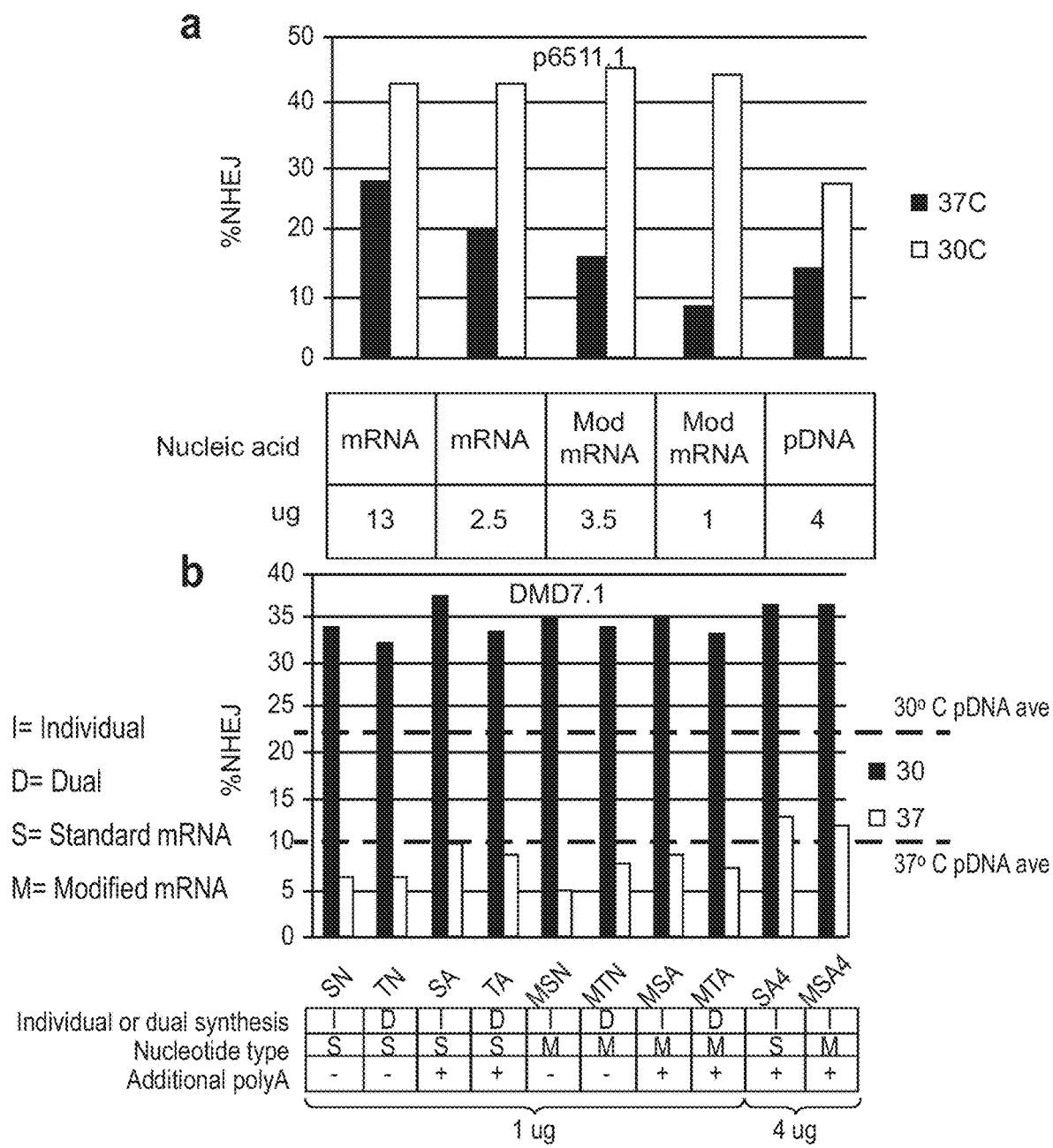
FIG. 20: Transfection of TALEN encoding mRNAs into livestock cells results in efficient target cleavage. Panel a: The indicated quantity of mRNA was transfected into pig fibroblasts and transfected cells were cultured at either 30 or 37 degrees Celsius for three days prior to indel analysis. Panel b: Percent NHEJ was determined. The average percent NHEJ for by transfection of 4 micrograms of plasmid DNA encoding the DMD7.1 TALENs is displayed by dashed lines for cells cultured at 30 or 37 degrees Celsius.

Example 12: Transfection of Livestock Cells with mRNAs Encoding TALENs Results in Efficient Target Cleavage FIG. 20 summarizes the efficient target cleavage produced by the transfection of TALEN encoding mRNAs into livestock cells. The TALEN sequences can be found in Table 10. TALEN cDNAs (TALEN pairs p6511.1 (SEQ ID NOS: 440, 441) and DMD7.1 (SEQ ID NOS: 410, 411)) were cloned downstream of the T3 promoter in the pT3TS cloning vector transcribed as described in Carlson, 2010 and purified using the MINELUTE PCR purification kit (Qiagen) prior to mRNA synthesis using the MMESSAGE MACHINE T3 kit (Applied Biosciences) according to the manufacturers protocol. Modified mRNA was synthesized from the same vectors with the MMESSAGE MACHINE T3 kit (Applied Biosciences) substituting a ribonucleotide cocktail consisting of 3'-O-Me-m7G(5')ppp(5')G RNA cap analog (New England Biolabs), 5-methylcytidine triphosphate pseudouridine triphosphate (TriLink Biotechnologies, San Diego, Calif.) and two standard ribonucleotides, adenosine triphosphate and guanosine triphosphate. mRNA synthesis reactions were DNAse treated prior to purification using the MEGACLEAR REACTION CLEANUP kit (Applied Biosciences). a) The indicated quantities of p6511.1 TALENs were transfected into pig fibroblasts (500,000-750,000 cells per replicate) using the NEON nucleofection system (Life Technologies) with the following settings: 1 pulse, 1800 v; 20 ms width and a 100 µl tip. Transfected cells were culture 3 days at either 30 or 37 degrees Celsius prior to indel analysis by the SURVEYOR assay (Transgenomic). Percent NHEJ was calculated as described in Guischin et. al., 2010, and plotted on the graph. Four micrograms of plasmid DNA (pDNA) encoding the p6511.1 TALENs was also transfected under the same conditions for comparison of % NHEJ. b) mRNA structure, composition or in vitro synthesis reaction scheme have little effect on TALEN activity. mRNA encoding the DMD7.1 TALENs was synthesized either by individually ("I" left and right TALENs in a separate reaction) or in the same reaction (Dual "D") using standard or modified ribonucleotides. The reactions were then split into two replicates, one of which an additional polyA tail was added using the Poly(A) Tailing Kit (Ambion) according to the manufacturers protocol.

Expression of TALENs from plasmid DNA has been an effective method for induction of TALEN mediated indels in livestock cells; however, integration of the TALEN encoding plasmids into the genomes of cells is possible. In contrast, mRNA cannot integrate into the genomes of host cells. To avoid the integration of TALEN encoding plasmids, an experiment was performed to determine if similar levels of TALEN activity could be achieved by transfection of mRNAs encoding TALENs. mRNA for TALENs encoding the p6511.1 TALEN pair was generated using either standard or modified ribonucleotides. Two quantities of each TALEN mRNA preparation were transfected into pig fibroblasts by nucleofection, cultured 3 days at 30 or 37 degrees Celsius prior to analysis of indels. Percent NHEJ was similar for all mRNA transfections incubated at 30 degrees Celsius while a dosage response could be observed for transfected cells incubated at 37 degrees Celsius. A significant difference in percent NHEJ between modified and standard ribonucleotides could not be detected in this replicate, however, equivalent quantities were not used. Notably, mRNA transfection in all groups incubated at 30 degrees C. significantly outperformed the p6511.1 TALENs transfected as plasmid DNA under the same conditions.

Another experiment was performed to examine the influence of modified versus standard nucleotide synthesized mRNA at a second locus, porcine DMD. This experiment also evaluated whether addition of a polyA tail influenced TALEN activity, and whether each TALEN monomer (left and right monomers) could be synthesized in the same transcription reaction (Dual) or if they must be synthesized individually and mixed prior to transfection. One or four micrograms of DMD7.1 TALEN mRNA were transfected into pig fibroblasts and cultured 3 days at 30 or 37 degrees Celsius. As with the p6511.1 TALENs, little difference was observed in TALEN activity in cells cultured at 30 degrees Celsius suggesting that neither modified nucleotides, in vitro poly adenylation of mRNAs or dual transcription of mRNAs had an influence on activity. A dosage response could again be observed in the 37 degree cultured replicates as 4 µg of mRNA outperformed 1 µg transfections. Also, polyadenylated mRNAs appeared to outperform non adenlyated mRNAs in 37 degree replicates.

Notably when plasmid DNA encoding the DMD7.1 TALENs was transfected into pig fibroblasts, a significant reduction (40-60%) in % NHEJ levels measured at day 3 versus cells cultured to day 14 was noticed (Example 3). No such reduction in % NHEJ was observed for any of the mRNA transfected replicates shown here, data not shown for day 14 modification levels. Thus mRNA transfection appears to be superior to DNA transfection not only for TALEN activity, but also for maintaining a high proportion of modified cells after an extended period in culture. Without being bound to a particular theory, it is believed that this result is due to improved cell viability when transfected with mRNA versus plasmid DNA.

of selection markers. Mutation frequency in analyzed clones were accurately predicted by the modification levels of the source population at day 3. Clones with bi-allelic modifications could also be readily identified. The results of this Example are summarized in Table 5. The target sequences are LDLR (SEQ ID NO: 242) (TALEN SEQ ID NOS: 438 and 439, 414-417), DMD exon 6 (SEQ ID NO:379) (TALEN SEQ NOS:434 and 437), DMD exon 7 (SEQ ID NO: 380) (TALEN SEQ ID NOS: 408-411), GHRHR (Gene ID 2692) (TALEN SEQ ID NOS:478 and 479), ACAN12 (SEQ ID NO: 378) (TALEN SEQ ID NOS: 401-404), and GDF8 (SEQ ID NOS: 351-353) (TALEN SEQ ID NOS:428 and 431).

TABLE 5

Genotype Distribution in Fibroblast Clones
Table of Genotype distribution in fibroblast clones.

| TALEN pair | Selection | | Day 3 Mod | Predicted % Mod Clones | Predicted % Bi-allelic Mod | Observed Mod Clones (%) | Observed Bi-allelic Mod (%) |
|---|---|---|---|---|---|---|---|
| LDLRE2.1 | Puro | Pig ♂ | 19 | 34.5 | 10.5 | 30/81 (37) | 5/26 (19) |
| LDLRE2.1 | Puro | Pig ♀ | 21.5 | 38.3 | 12 | 23/76 (30) | 8/23 (35)† |
| LDLRE2.1 | Puro | Pig ♂ | 14.4 | 26.7 | 7.7 | 12/94 (13) | 2/12 (≥17)$^A$ |
| LDLRE2.1-2x$^B$ | Puro | Pig | 19.7 | 35.5 | 10.9 | 8/24 (33) | 2/8 (≥25)$^A$ |
| LDLRE4.2 | Puro | Pig ♂ | 20 | 36 | 11.1 | 4/48 (8.3) | ½ (25)$^A$ |
| LDLRE4.2 | Puro | Pig ♀ | 19 | 34.4 | 10 | 8/47 (17) | 0/8$^A$ |
| DMDE6 | Puro | Pig | 25 | 43.8 | 15.6 | 17/35 (49) | NA |
| DMDE7.1 | Puro | Pig | 27 | 47 | 15.6 | 12/29 (41) | 3/10 (30) |
| DMDE7.1-2x$^B$ | Puro | Pig | 22 | 39.2 | 12.4 | 22/41 (54) | 7/22 (≥32)$^A$† |
| GHRHR2.3 | G-418 | Pig | 29 | 50 | 17 | 26/43 (60) | 15/26 (≥58)$^C$† |
| ACAN12 | Puro | Cow | 29 | 50 | 17 | 27/35 (77) | 2/6 (NA)$^D$ |
| btGDF83.1 | Puro | Cow | 17 | 31 | 9.3 | 7/24 (29) | 0/7 |
| GHRHR2.3 | None | Pig ♂ | 32.5 | 55 | 19.4 | 21/25 (84) | 6/21 (≥29)$^A$ |
| GHRHR2.3 | None | Pig ♀ | 35 | 58 | 21 | 13/13 (100) | 3/13 (≥23)$^A$ |
| LDLR2.1 | None | Pig ♀ | 34 | 57 | 20 | 88/166 (53) | 5/16 (31%) |
| btGDF83.1 | None | Cow | 29 | 50 | 17 | 23/45 (51) | 2/23 (≥9)$^E$ |
| btGDF83.1 | None | Cow | 35 | 58 | 21 | 23/41 (56) | 7/23 (≥30)$^E$ |

$^A$Bi-allelic KO were identified by sequencing of PCR products. Only overlapping or homozygous deletions can be identified using this technique.
$^B$Fibroblasts were transfected and recovered twice within two weeks with the same TALEN pair.
$^C$⁵/₁₅ Bi-allelic colonies were confirmed as double frame-shift alleles.
$^D$Only colonies with distinguishable gross deletions in the PCR amplicon were analyzed.
$^E$Bi-allelic KO colonies were identified by high definition melt analysis. Only homozygous modifications can be identified.
†95% Confidence interval exceeds expected bi-allelic null hypothesis

Example 13: Analysis of Colonies Created by mRNA Transfection with No Selection One to four micrograms of mRNA encoding TALENs were added, as in Example 12, to *bovine* or swine primary fibroblasts. The cells were grown at 30° C. for three days after exposure to TALENs and cells were enumerated and plated at a range of densities 1-20 cells/cm2 on 10 cm dishes. Cells were cultured for 10-15 days until individual colonies of 3-4 mm in diameter could be observed. Colonies were aspirated with a p-200 pipettor under gentle aspiration and expelled into a well of 24-well plate with 500 µl of growth medium (Carlson, 2011). Plates with clearly defined colonies (~10-30/plate) were chosen for colony aspiration to limit the chance of aspirating cells from multiple colonies. Once a colony reached 70-90 percent confluent in the 24-well dish, a portion was harvested for indel analysis and the remainder was cryopreserved. The results of the indel analysis are located in the last five lines of Table 5. These results demonstrate that colonies can be readily isolated from TALEN mRNA transfected fibroblasts without the use

Example 14: Co-Transfection of mRNA Encoded TALENs and ssODNs Enhances HDR

Figure 21:
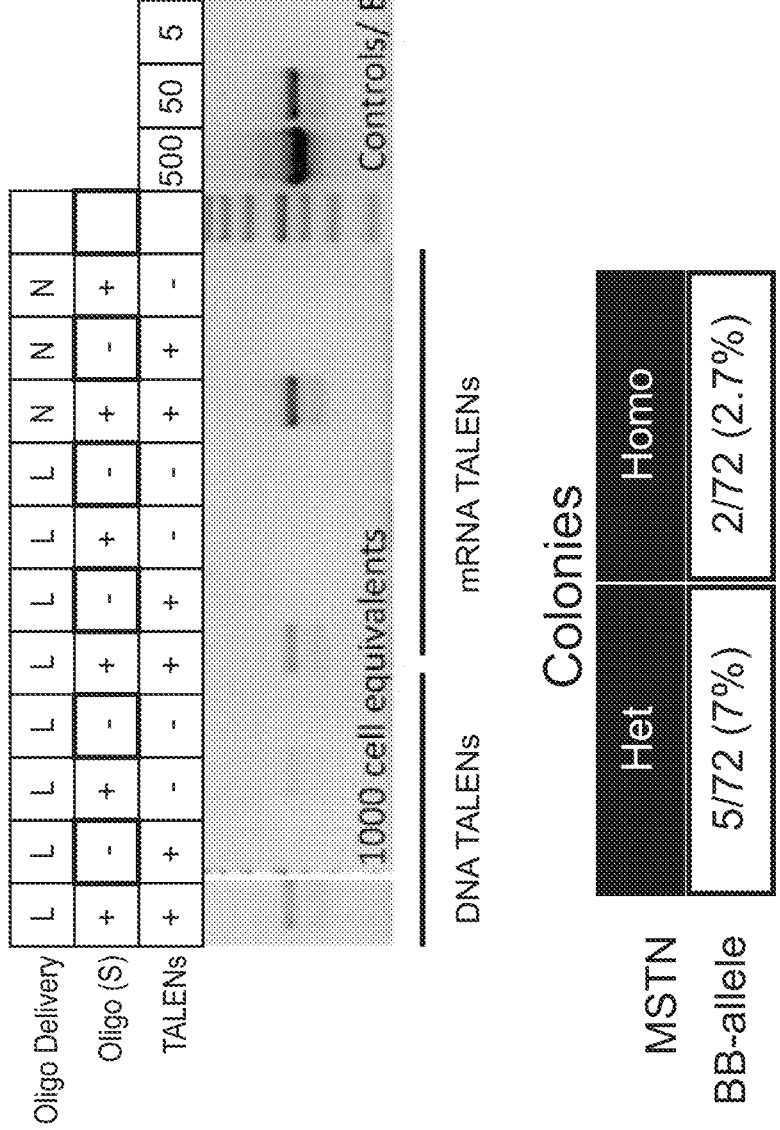
FIG. 21: Transfection of mRNA encoded TALENs enhances ssODN HDR. btGDF83.1 TALEN mRNA and BB-HDR sense ssODN (SEQ ID NO:133) were introduced into Wagyu cells by the specified mechanism and HDR was measured by PCR assay described above. Colonies were isolated from the population of cells where both TALEN mRNA and the ssODNs were delivered simultaneously by nucleofection.

FIG. 21 sets forth a summary of experimental results for modifying Wagyu cells with a combination of mRNA encoding TALENs and single-stranded oligonucleotides. The cells were Waygu cells and the allele was the Belgian Blue. Experimentation, cell type and locus assayed was the same as in Example 11 with the exception that TALEN encoding mRNA (2 ug) was delivered in place of DNA encoded TALENs (where indicated) and only the sense ssODN was used. No selection markers were introduced in these cells at any stage. Population analysis at day three revealed HDR in both DNA and mRNA transfected cells when the ssODN was introduced 24 hours after TALENs. Peak activity (~10%) was observed in cells co-transfected with the ssODN and TALEN mRNA by nuclofection. This result contrasts the previous result with DNA encoding TALENs which were unable to stimulate HDR at a measurable frequency. Among individual colonies, prepared as in Example 12, both heterozygous and homozygous introgression of the Belgian Blue allele could be observed at 5 and 2 percent, respectively.

Figure 22:
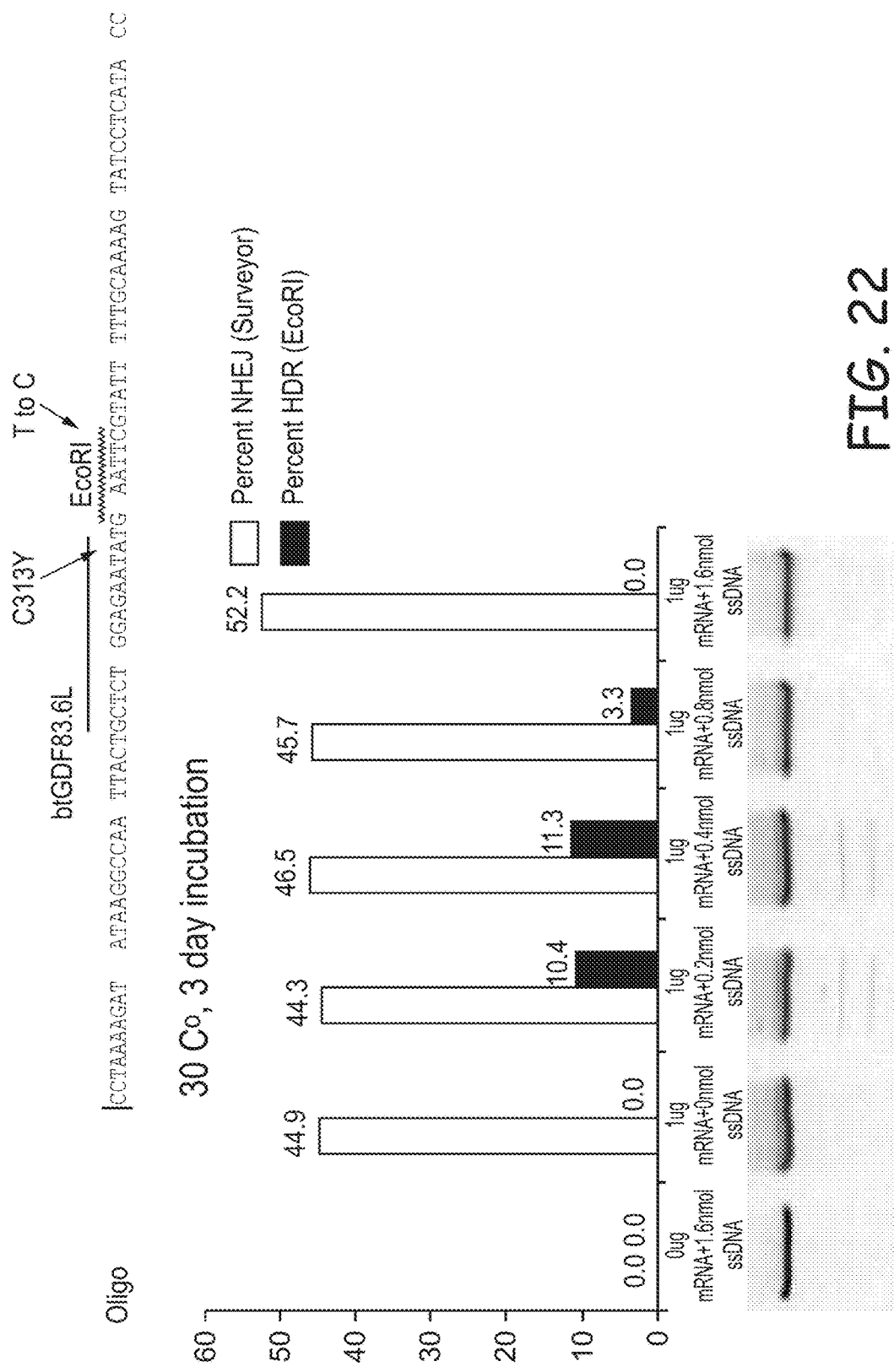
FIG. 22: Introgression of naturally occurring alleles within a species using mRNA encoded TALENs and ssODNs. The Piedmontese Myostatin allele C313Y was introgressed into Waygu fibroblasts by the methods of FIG. 21 using btGF83.6-G (SEQ ID NO: 351). The sequence labeled "oligo" is has SEQ ID NO:503.
Figure 23:
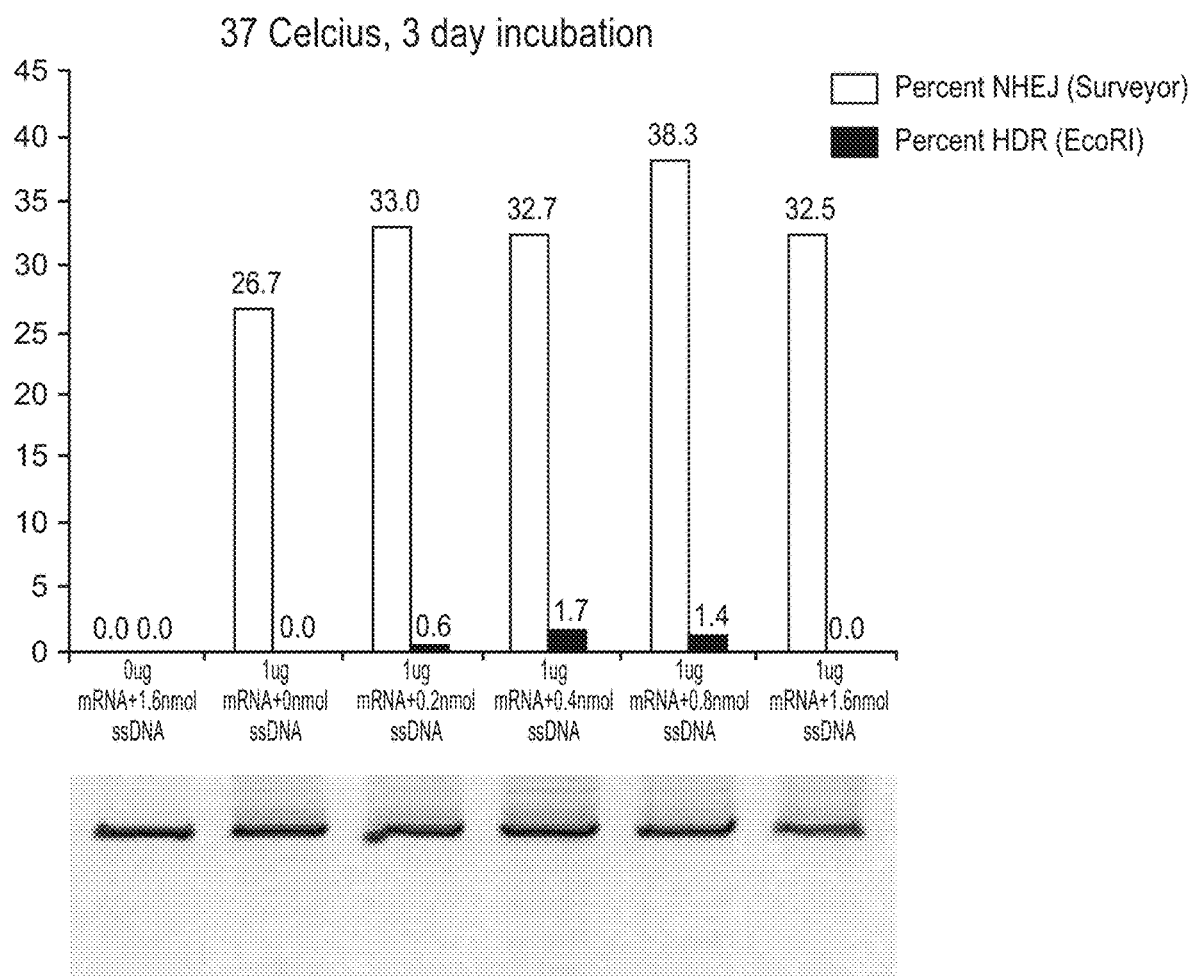
FIG. 23: The process of FIG. 22 was repeated at a different temperature (37° C.) using btGF83.6-G (SEQ ID NO: 351).

Example 15: Introduction of Single Base Alterations Using ssODNs and mRNA Encoding TALENs FIGS. 22 and 23 depict results of another study wherein a single nucleotide polymorphism was replicated. This polymorphism was known to cause a coding change to the *bovine* GDF8 locus, C313Y, known to cause hypermuscularity in Piedmontese cattle (Kambadur, 1997; Genome Res. 1997 7: 910-915 An additional SNP was introduced into the ssODN to create a silent EcoRI site to aid in screening and/or quantification of HDR. mRNA and ssODNs were introduced simultaneously by nucleofection as indicated in Examples 11 and 13 with relative quantities indicated. (SEQ ID NOS: 503 and 431) FIGS. 22 and 23 show results when transfected cells are incubated at 30 and 37 degrees Celsius for three days. Peak levels of homologous recombination were significantly higher at 30 degrees Celsius (11.3%) than at 37 (1.7%), despite similar activity of the TALENs. (SEQ ID NOS: 442 and 443) The data shows that from about 0.2 to about 0.4 nmol ssDNA is effective for homologous recombination both at 30 and 37 degrees Celsius. Surprisingly, a bi-phasic effect was observed, with too great of an oligonucleotide concentration/amount abolishing the recombination. No selection markers were used in these cells at any stage.

Example 16: Alleles Introduced into Pig (Ossabaw) Cells Using Oligo HDR

FIG. 24 sets forth a summary of experimental results for modifying cells with a combination of mRNA encoded TALENs and single-stranded oligonucleotides to place an allele that occurs naturally in one species to another species (interspecific migration). Piedmontese GFD8 SNP C313Y (SEQ ID NOS: 444 and 445), as in Example 15, was chosen as an example and was introduced into Ossabow swine cells. Experiments were performed as in Example 15 with Ossabaw swine cells substituted for Wagyu cells. No markers were used in these cells at any stage. A similar peak in HDR was observed between pig and cattle cells at 0.4 nmol ssODN, (FIG. 22, 23) however, HDR was not extinguished by higher concentrations of ssODN in Ossabaw fibroblasts.

Example 17: Cloning for Alleles Introduced into Cells Using Oligo HDR

Figure 25:
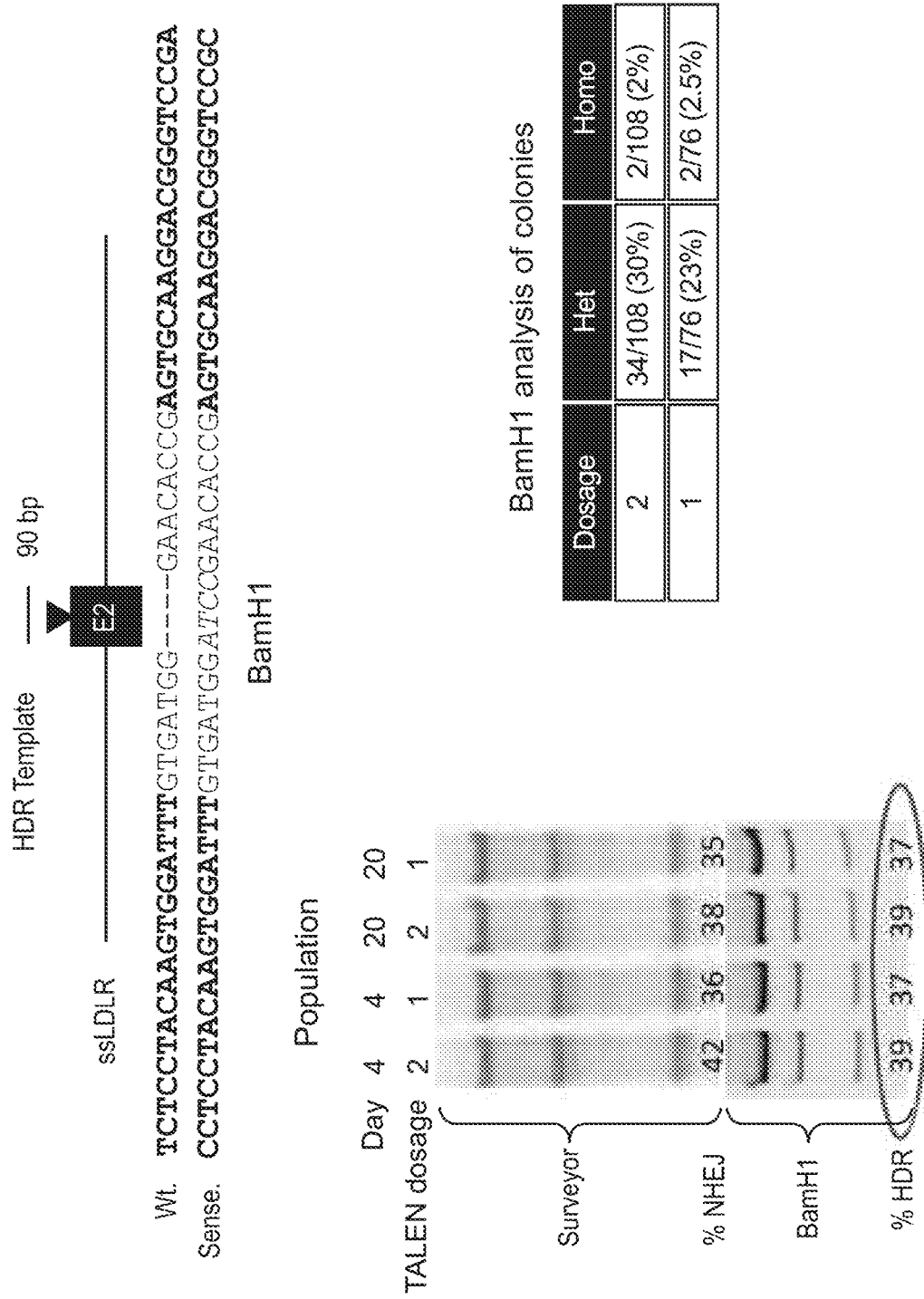
FIG. 25: Introduction of a particular frameshift allele into porcine LDLR using mRNA encoded TALENs and ssODNs. A 90-bp oligo was created to introduce a 4 base pair insertion into exon 2 of the porcine LDLR gene. The insertion creates a novel BamH1 site and is predicted to cause a frameshift allele. After co-transfection of ssLDLR2.1 TALEN mRNA (at indicated dosage in micrograms) and 0.3 nMol of ssODN cells were cultured at 30.0 for 3 days, followed by an additional day at 37° C. NHEJ was measured by SURVEYOR assay at days 4 and 20. Percent HDR was determined by BamH1 digest of PCR products that include exon 2 of porcine LDLR and quantification of restriction fragments (indicative of HDR) and comparison to wild type products (top product, no HDR) by densitometry. Colonies were isolated from each treatment and analyzed by PCR and BamH1 digest. The sequence labeled "Wt" has SEQ ID NO:523 and the sequence labeled "Sense" has SEQ ID NO:524.

FIG. 25 sets forth a summary of experimental results for modifying cells with a combination of mRNA encoded TALENs and single-stranded oligonucleotides to place an allele into cells for cloning animals. A new allele (BamH1) was introduced into Ossabaw swine cells designed to introduce a 4 base pair insertion that would both create frameshift allele and introduce a novel BamH1 site. Two or 1 micrograms of ssLDLR2.1 TALEN mRNA (SEQ ID NOS: 438 and 439) and 0.3 nmol of ssODN was introduced into Ossabaw cells as in Examples 11 and 13. (SEQ ID NO: 506) Surprisingly, there was synergy between the ssODNs and the TALEN activity as the previous maximum for this TALEN pair without ssODN was 25% NHEJ. This synergy was unexpected and not predictable based on current understanding of the relevant molecular mechanisms. HDR was detected by restriction digest of PCR amplicons with BamH1. HDR levels were similar to NHEJ levels suggesting that the majority of TALEN induced breaks were repaired with the ssODN. Analysis of individual colonies, generated, as in example 13, revealed heterozygous and homozygous modification of up to 30 and 2.5 percent respectively. No selection markers were used in these animals at any stage. TALEN treated cells were cloned by chromatin transfer, implanted into surrogate sows and resulted in the establishment of pregnancies.

Example 18: DNA and mRNA Encoded TALENs are Active in Spermatigonial Stem Cells Results are summarized in FIG. 26. Porcine germ cells were isolated from 10 wk old boars, and enriched by differential. Plasmids encoding eGFP and DMD-specific TALENs were transfected into germ cells using the AMAXA NUCLEOFECTOR system Amaxa solutions "V"- and "L" and "B" using programs X-001 and X-005. (SEQ ID NOS: 504, 505, 506) Each transfection reaction was performed with $10^6$ of enriched germ cells, and indicated micrograms of TALEN encoding plasmid DNA. The same methods were used to deliver mRNAs encoding DMD7.1 TALENs. After nucleofection, the cells were cultured for 5 days in 5% $CO_2$ atmosphere at 37° C. or 30° C. Transfection efficiency was evaluated by immunofluorescence analysis for co-localization of expression of GFP and UCH-L1. Cell viability was evaluated by trypan blue exclusion.

Example 19: TALEN Stimulated HDR in Primordial Germ Cells

TALEN stimulated HDR was also tested in chicken primordial germ cells (PGCs) at the chicken Ddx4 locus. Two TALEN pairs were constructed, on to intron 1 (Tal1.1) (SEQ ID NOS: 446 and 447) and exon 7 (Tal7.1) (SEQ ID NOS: 448 and 449) and their function was verified in DF1 chicken cells, see FIG. 27. Tal1.1 lies within the homologous sequence of the donor targeting vector. Tal7.1 lies outside the homologous sequence of the donor targeting vector. See also Example 7. Subsequently, each TALEN pair was cotransfected with the donor targeting vector designed to fuse GFP with Exon 2 of the Ddx4 gene (Panel b). As expected cleavage with Tal 1.1 stimulated homologous recombination (panel c) whereas Tal 7., which lies outside of the homologous sequence in the donor targeting vector, did not stimulate HDR.

Example 20: TALEN Designing and Production

Candidate TALEN target DNA sequences and RVD sequences for examples 20-40 were identified using the online tool "TAL EFFECTOR NUCLEOTIDE TARGETER". Plasmids for TALEN DNA transfection or in vitro TALEN mRNA transcription were then constructed by following the Golden Gate Assembly protocol using pCGOLD-YTALEN (Addgene ID 38143) and RCIscript-GOLD-YTALEN (Addgene ID 38143) as final destination vectors (Carlson 2012). The final pC-GoldyTALEN vectors were prepared by using PureLink® HIPURE PLASMID MIDIPREP Kit (Life Technologies) and sequenced before usage. Assembled RCIscript vectors prepared using the QIAPREP SPIN MINIPREP kit (Qiagen) were linearized by SacI to be used as templates for in vitro TALEN mRNA transcription using the mMESSAGE mMACHINE® T3 Kit (Ambion) as indicated elsewhere. Modified mRNA was synthesized from RCIScript-GOLDYTALEN vectors as described in Carlson 2012 substituting a ribonucleotide cocktail consisting of 3'-0-Mem7G(5')ppp(5')G RNA cap analog (New England Biolabs), 5-methylcytidine triphosphate pseudouridine triphosphate (TriLink Biotechnologies, San Diego, Calif.) and adenosine triphosphate guanosine triphosphate. Final nucleotide reaction concentrations are 6 mM for the cap analog, 1.5 mM for guanosine triphosphate, and 7.5 mM for the other nucleotides. Resulting mRNA was DNAse treated prior to purification using the MEGA-CLEAR REACTION CLEANUP kit (Applied Biosciences).

Example 21: CRISPR/Cas9 Design and Production

Gene specific gRNA sequences were cloned into the Church lab gRNA vector (Addgene ID: 41824) according their methods. The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI-AgeI fragment from the hCas9 plasmid (encompassing the hCas9 cDNA) into the RCIScript plasmid. Synthesis of mRNA was conducted as above except that linearization was performed using KpnI.

Example 22: Donor Repair Template Preparation

A) Bb-Hdr (1,623 Bp) Plasmid.
A 1,695 bp fragment encompassing the Belgian Blue allele was PCR amplified (btGDF8 BB 5-1: 5'-CAAAGTTGGTGACGTGACAGAGGTC (SEQ ID NO:328); btGDF8 BB 3-1: 5'-GTGTGCCATCCC-TACTTTGTGGAA (SEQ ID NO:329)) from Belgian Blue genomic DNA and TOPO cloned into the PCR 2.1 vector (Life Technologies). This plasmid was used as positive control template for analytical primer sets and for derivation of the 1,623 bp BB-HDR template by PCR with following primers (BB del HR 1623 5-1: 5'-GATGTATTCCTCA-GACTTTTCC (SEQ ID NO:330); BB del HR 1623 3-1: 5'-GTGGAATCTCATCTTACCAA, SEQ ID NO:331) and TOPO cloned as before. Each plasmid was sequence verified prior to use. Transfection grade plasmid was prepared using the Fast-Ion MIDI PLASMID ENDO-FREE kit (IBI Scientific). rAAV packaging. BB-HDR was cloned into pAAV-MCS and packaged into using the ADENO-ASSOCIATED VIRUS HELPER-FREE system (Agilent). Briefly, a 10 cm dish AAV-293 cells was transfected with 5 µg each: pAAV-Helper, pAAV-RC and the AAV-BB-HDR plasmid. Two days post transfection, the cells were removed from the plate by scraping into 1 ml of growth media. Viral particles were released by 3 freeze-thaw cycles prior to centrifugation at maximum speed in a microcentrifuge for 5 minutes. The supernatant was aspirated and used directly for infection of target cells.
B) Polled 1592 Template.
A 1,784 bp fragment encompassing 383 the POLLED allele was PCR amplified (F1: 5'-GGGCAAGTTGCTCAGCTGTTTTG (SEQ ID NO:332); R1-5'-TCCGCATGGTTTAGCAGGATTCA, SEQ ID NO:333) from angus genomic DNA and TOPO cloned into the PCR 2.1 vector (Life Technologies). This plasmid was used as positive the control template for analytical primer sets and for derivation of the 1,592 bp HDR template by PCR with following primers (1594 F: 5'-ATCGAACCTGGGTCTTCTGCATTG SEQ ID NO:334; R1: 5'-TCCGCATGGTTTAGCAGGATTCA, SEQ ID NO:335) and TOPO cloned as before. Each plasmid was sequence verified prior to use. Transfection grade plasmid was prepared using the Fast-Ion MIDI PLASMID Endo-Free kit (IBI Scientific) and 5 µg or 10 µg was transfected along with 2 µg HP1.3 TALEN mRNA (SEQ ID NOS: 464 and 465) Oligonucleotide templates. All oligonucleotide templates were synthesized by Integrated DNA Technologies, 100 nmole synthesis purified by standard desalting, and resuspended to 400 µM in TE.

Example 23: Tissue Culture and Transfection

Pig or cattle fibroblasts were maintained at 37 or 30° C. (as indicated) at 5% $CO_2$ in DMEM supplemented with 10% fetal bovine serum, 100 I.U./ml penicillin and streptomycin, and 2 mM L-Glutamine. For transfection, all TALENs and HDR templates were delivered through transfection using the Neon Transfection system (Life Technologies) unless otherwise stated. Briefly, low passage Ossabaw, Landrace, Wagyu, or Holstein fibroblasts reaching 100% confluence were split 1:2 and harvested the next day at 70-80% confluence. Each transfection was comprised of 500,000-600,000 cells resuspended in buffer "R" mixed with plasmid DNA or mRNA and oligos and electroporated using the 100 µl tips by the following parameters: input Voltage; 1800V; Pulse Width; 20 ms; and Pulse Number; 1. Typically, 2-4 µg of TALEN expression plasmid or 1-2 µg of TALEN mRNA and 2-3 µM of oligos specific for the gene of interest were included in each transfection. Deviation from those amounts is indicated in the figure legends. After transfection, cells were divided 60:40 into two separate wells of a 6-well dish for three days' culture at either 30 or 37° C. respectively. After three days, cell populations were expanded and at 37° C. until at least day 10 to assess stability of edits.

Example 24: Dilution Isolation of Cellular Clones

Three days post transfection, 50 to 250 cells were seeded onto 10 cm dishes and cultured until individual colonies reached about 5 mm in diameter. At this point, 6 ml of TrypLE (Life Technologies) 1:5 (vol/vol) diluted in PBS was added and colonies were aspirated, transferred into wells of a 24-well dish well and cultured under the same 420 conditions. Colonies reaching confluence were collected and divided for cryopreservation and genotyping. Sample preparation: Transfected cells populations at day 3 and 10 were collected from a well of a 6-well dish and 10-30% were resuspended in 50 µl of 1×PCR compatible lysis buffer: 10 mM Tris-Cl pH 8.0, 2 mM EDTA, 0.45% Tryton X-100 (vol/vol), 0.45% Tween-20 (vol/vol) freshly supplemented with 200 µg/ml Proteinase K. The lysates were processed in a thermal cycler using the following program: 55° C. for 60 minutes, 95° C. for 15 minutes. Colony samples from dilution cloning were treated as above using 20-30 µl of lysis buffer.

Example 25: Plasmid and rAAV HDR in Wagyu Fibroblasts

Low passage Wagyu fibroblasts were cultured to 70-90% confluence and transfected by NUCLEOFECTION (Lonza) with 2 µg each TALEN expression plasmid (btGDF83.1L+NR, SEQ ID NO: 428) along with 750 ng of SLEEPING BEAUTY transposon components as described in Carlson 2012. For conditions where plasmid HDR template was used, 2 µg of BB-HDR plasmid was also included in the transfection. Transfected cells were split between two wells of a 6-well plate for culture at 30 or 37° C. For conditions using rAAV HDR template, 150 µl of viral lysate was added to each well 2 hours post transfection. After incubation for three days, cells were harvested by trypsinization, a portion of which were lysed for analysis of HDR at day 3, and the remainder were plated for colony isolation as described in Carlson 2012.

Example 26: Mutation Detection and RFLP Analysis

PCR flanking the intended sites was conducted using PLATINUM TAQ DNA POLYMERASE HIFI (Life Technologies) with 1 µl of the cell lysate according to the manufacturer's recommendations. The frequency of mutation in a population was analysed with the SURVEYOR MUTATION DETECTION Kit (Transgenomic) according to the manufacturer's recommendations using 10 ul of the PCR product as described above. RFLP analysis was performed on 10 µl of the above PCR reaction using the indicated restriction enzyme. SURVEYOR and RFLP reactions were resolved on a 10% TBE polyacrylamide gels and visualized by ethidium bromide staining. Densitometry measurements of the bands were performed using ImageJ; and mutation rate of SURVEYOR reactions was calculated as described in Guschin et al., 2010. Percent HDR was calculated via dividing the sum intensity of RFLP fragments by the sum intensity of the parental band+RFLP fragments. For analysis of mloxP insertion, small PCR products spanning the insertion site were resolved on 10% polyacrylamide gels and the insert versus wild type alleles could be distinguished by size and quantified. RFLP analysis of colonies was treated similarly except that the PCR products were amplified by 1×MYTAQ RED Mix (Bioline) and resolved on 2.5% agarose gels. For analysis of clones for introgression of the GDF8 G938A-only (oligos lacked a novel RFLP), colonies were initially screened by a three primer assay that could distinguish between heterozygous ad homozygous introgression. Briefly, lysates from pig or cattle colonies were analysed by PCR using 1×MYTAQ RED MIX (Bioline) using the following primers and programs. Cattle GDF8 (Outside F1: 5'-CCTTGAGGTAG-GAGAGTGTTTTGGG, SEQ ID NO:336, Outside R1: 5'-TTCACCAGAAGACAAGGAGAATTGC, SEQ ID NO:337, Inside F1: 5'-TAAGGCCAATTACTGCTCTGGA-GACTA, SEQ ID NO:338; and 35 cycles of (95° C., 20 s; 62° C., 20 s; 72° C., 60s). Pig GDF8: Outside F1: 5'-CCTTTTTAGAAGTCAAGGTAACAGACAC, SEQ ID NO:339, Outside R1: 5'-TTGATTGGAGA-CATCTTTGTGGGAG, SEQ ID NO:340 Inside F1: 5'-TAAGGCCAATTACTGCTCTGGAGATTA, SEQ ID NO:341; and 35 cycles of (95° C., 20 s; 58° C., 20 s; 72° C., 60s). Amplicons from candidates were sequenced directly and/or TOPO cloned (Life Technologies) and sequenced by Sanger sequencing. To detect TALEN-mediated HDR at with the BB-HDR template, either 1 µl or 1 µl of a 1:10 dilution of PCR-lysate (1,000 cells/ul) was added to a PCR reaction with PCR primers bt GDF8 BB 5-1 (primer "c") and primer "c" (BB-Detect 3-1-5'-GCATCGAGATTCTGT-CACAATCAA, SEQ ID NO:342) and subjected to PCR with using 1× MYTAQ RED MIX (Bioline) for 40 cycles (9 459 5° C., 20 s; 66° C., 20 s; 72° C., 60s). To confirm HDR in colonies identified by the above PCR, amplification of the entire locus was performed with primers bt GDF8 BB 5-1 and bt GDF8 BB 3-1 followed by TOPO cloning (Life Technologies) and sequencing.

Example 27: Detection of POLLED Introgression

Detection of POLLED introgression was performed by PCR using the F1 primer (see above) and the "P" primer (5'-ACGTACTCTTCATTTCACAGCCTAC, SEQ ID NO:343) using 1× MyTaq Red mix (Bioline) for 38 cycles (95° C., 25s; 62° C., 25s; 72° C., 60s). A second PCR assay was performed using (F2: 5'-GTCTGGGGTGAGA-TAGTTTTCTTGG, SEQ ID NO:344; R2-5'-GGCAGAGATGTTGGTCTTGGGTGT, SEQ ID NO:345). Candidates passing both tests were analysed by PCR using the flanking F1 and R1 primers followed by TOPO cloning and sequencing. Detection of FecB introgression was performed as previously described for sheep. Callipyge introgression was detected by an AVAII RFLP assay. See results in FIG. 35.

Example 28: Amplicon Sequencing and Analysis

DNA was isolated from transfected populations and 100-250 ng was added to a 50 µl PLATINUM TAQ DNA POLYMERASE HIGH FIDELITY (Life Technologies) assembled per the manufacturer's recommendations. Each sample was assigned a primer set with a unique barcode to enable multiplex sequencing. A portion of the PCR product was resolved on a 2.5% agarose gel to confirm size prior to PCR cleanup using the MINELUTE PCR PURIFICATION Kit (Qiagen). Samples were quantified and pooled into a single sample for sequencing. The single combined sample was spiked with 25% PhiX (for sequence diversity) and sequenced on an Illumina MISEQ sequencer generating 150 base-pair paired-end reads. Read quality was assessed using FASTQC Read-pairs with overlapping ends were joined using FASTQ-JOIN from the EA-UTILS package. A custom PERL script was used to demultiplex the joined reads and count insert types. Exact matches to the forward and reverse primers were required in the demultiplexing step. Cloned animals were genotyped by RFLP assay and sequencing.

Example 29 Evaluation of Transfected mRNA as a Source of TALENs

Figure 36:
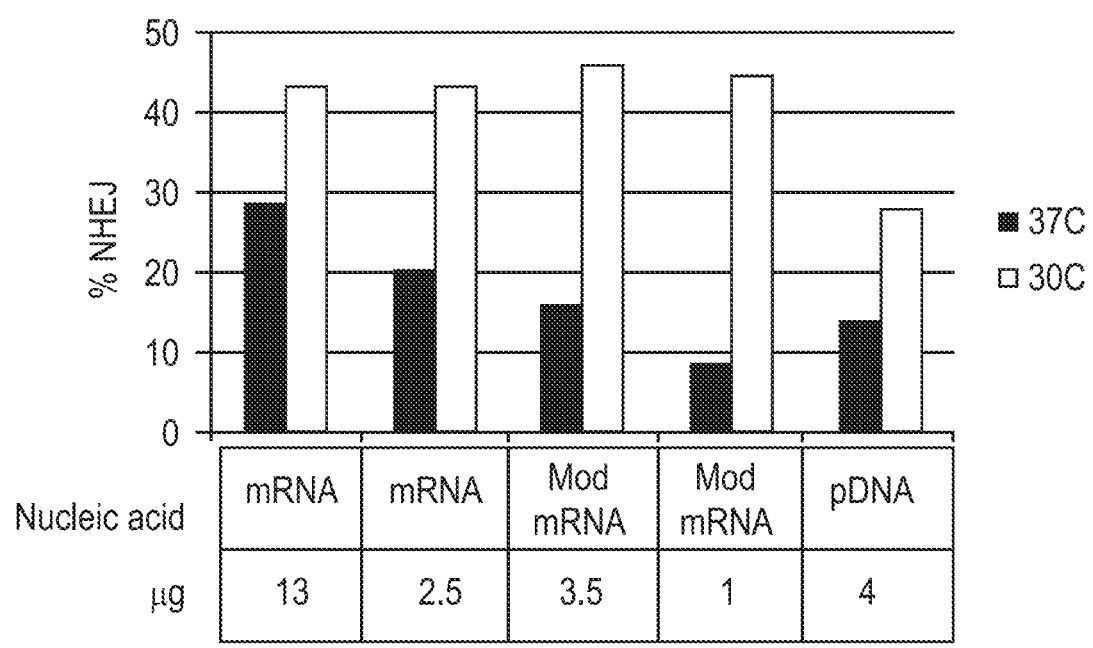
FIG. 36: A plot of experimental data generated for evaluation of transfected mRNA as a source of TALENs. TALENs were introduced into fibroblasts encoded by either unmodified mRNA, modified mRNA (mod mRNA) or plasmid DNA (pDNA). Two quantities of each TALEN preparation were transfected into cells subsequently cultured 3 days at 30° C. or 37° C. prior to analysis of indels, reported as % NHEJ.

Referring to FIG. 36, TALENs were introduced into pig fibroblasts encoded by either unmodified mRNA, modified mRNA (mod mRNA) or plasmid DNA (pDNA). Two quantities of each TALEN preparation were transfected into cells by nucleofection (Lonza), cultured 3 days at 30° C. or 37° C. prior to analysis of indels. Percent NHEJ was similar for all mRNA transfections incubated at 30° C., while a dosage response could be observed for transfected cells incubated at 37° C. Notably, mRNA transfection in all groups incubated at 30° C. significantly outperformed the TALENs transfected as plasmid DNA under the same conditions. There was little difference between modified and unmodified mRNA in this test. TALENs: CTCCTCCATTGCGGA-CATGGACTTCTCAGCCCTTCTGAGTCAGATC (SEQ ID NO:346), underlines indicate TALENs binding sites.

Example 30: Kinetics of TALEN Induced HDR with Oligonucleotide Templates

Referring to FIG. 37A, an mRNA source of TALENs stimulated efficient and consistent HDR using an oligo donor. Each chart displays results of targeting a specific locus in fibroblasts (e.g., ssIL2RG; "ss" for *Sus scrofa* and "bt" for *Bos taurus*) using oligo donor templates and TALENs delivered as plasmid DNA or mRNA. (Insets) ssIL2RG2.1 (SEQ. ID NOS: 484 and 485); ssRAG2.1 (SEQ ID NOS: 488 and 489); btGGTA9.1 (SEQ ID NOS: 490 and 491); ssLDLR2.1 (SEQ ID NOS: 438 and 439) Diagrams of the oligo templates, in which the shaded boxes represent the TALEN-binding site and the spacers are shown in white. Each oligo contains either a 4-bp insertion (ins4) or deletion (del4) that introduces a novel restriction site for RFLP analysis. Presumptive BMs replace the conserved −1 thymidine (relative to the TALEN-binding site) with the indicated nucleotide. Fibroblasts were transfected with either TALEN-encoding plasmids (3 µg) or mRNA (1 µg) along with 3 µM of their cognate oligo-homologous template. Cells were then incubated at 37° C. or 30° C. for 3 d before expansion at 37° C. until day 10. TALEN activity was measured by the Surveyor assay at day 3 (Day3 Surveyor), and HDR was measured at days 3 and 10 by RFLP analysis (Day3% HDR and Day10% HDR). Each bar displays the average and SEM from three replicates.

Referring to FIG. 37B, porcine fibroblasts were transfected with either TALEN-encoding mRNA or plasmid DNA and oligos with 4 base pair insertions targeting LDLR or APC genes. Cells from each transfection were then evenly split into seven 24-well plate wells, cultured at 30° C. and assayed by RFLP at the indicated time points. Panel a) RFLP analysis on cell populations at indicated time points. Panel b) Results from panel a were quantified by densitometry and the averages were plotted as a function of time with SEM (n=3). HDR signal first appears 12 hours post-transfection and accumulates over time. The onset of HDR at LDLR was independent of TALEN source, but the rate of HDR between 24 and 72 hours was much higher when mRNA was used compared to plasmid DNA.

Example 31: Influence of Mutation Type on the Frequency of HDR

Referring to FIG. 38, panel a) The sequence of five oligos used to target ssLDLR. Oligos vary in length and type of mutation. TALEN binding sites are indicated in boxed text and the novel BamHI site is underlined. SNPs including BMs and insertions are circled. Panel b) Cells were transfected with LDLR2.1 TALEN mRNA (1 µg) and oligos (2 µM final). HDR at day 3 was determined by RFLP analysis and the average with SEM (n=3) was plotted. The results suggest that insertion alleles are more efficiently incorporated than SNPs or deletions, but that homology length from 46-90 bp has negligible influence on HDR efficiency. c) Cattle cells were transfected with btRosa1.2 TALEN mRNA and either 41_mloxP or 60_loxP oligos (2 µM final). The numbers 41 and 60 refer to the number of homologous bases. Each oligo contains a 34 bp loxP site, either a modified (mloxP) or wild type (loxP) version, in the center of the spacer. Densitometry at day 3 and 15 show that insertion of loxP sites is both efficient and stable.

Example 32: CRISPR/Cas9 Mediated HDR to Introgress the p65 S531P Mutation from Warthogs into Conventional Swine Referring to FIG. 39, panel a) The S531P missense mutation is caused by a T-C transition at nucleotide 1591 of porcine p65. The S-P HDR template includes the causative TC transition mutation (oversized text) which introduces a novel XmaI site and enables RFLP screening. Two gRNA sequences (P65_G1S and P65_G2A) are shown along with the p65.8 TALENs used in previous experiments. Panel b) Landrace fibroblasts were transfected with S—P-HDR oligos (2 µM), two quantities of plasmid encoding hCas9 (0.5 µg or 2.0 m); and five quantities of the G2A transcription plasmid (0.05 to 1.0 µg). Cells from each transfection were split 60:40 for culture at 30 and 37° C. respectively for 3 days before prolonged culture at 37° C. until day 10. Surveyor assay revealed activity ranging from 16-30%. Panels c and d) RFLP analysis of cells sampled at days 3 and 10. Expected cleavage products of 191 and 118 bp are indicated by black arrows. Despite close proximity of the double stranded break (DSB) to the target SNP, CRISPR/Cas9 mediated HDR was less efficient than TALENs for introgression of S531P. Individual colonies were also analyzed using each gRNA sequence (data not shown).

Referring to FIG. 40, experiments were made for comparison of TALENs and CRISPR/Cas9 mediated HDR at porcine APC. Panel a) APC14.2 TALENs and the gRNA sequence APC14.2 G1a are shown relative to the wild type APC sequence. Below, the HDR oligo is shown which delivers a 4 bp insertion (orange text) resulting in a novel HindIII site. Pig fibroblasts transfected with 2 µM of oligo HDR template, and either 1 µg TALEN mRNA, 1 µg each plasmid DNA encoding hCas9 and the gRNA expression plasmid; or 1 µg mRNA encoding hCas9 and 0.5 µg of gRNA expression plasmid, were then split and cultured at either 30 or 37° C. for 3 days before expansion at 37° C. until day 10. Panel b) Charts displaying RFLP and Surveyor assay results. TALEN stimulated HDR was most efficient at 30° C., while CRISPR/Cas9 mediated HDR was most effective at 37° C. For this locus, TALENs were more effective than the CRISPR/Cas9 system for stimulation of HDR despite similar DNA cutting frequency measured by Surveyor assay. In contrast to TALENs, there was little difference in HDR when hCas9 was delivered as mRNA versus plasmid.

Example 33: SNP Introgression Using Oligo Donors

Referring to FIG. 41, panel a) The influence of blocking mutations (BM) on maintenance of HDR alleles was evaluated in pig LDLR and GDF8. Each oligo was designed to introduce the same SNPs/restriction 313 site plus or minus blocking mutations. HR was quantified in transfected populations initially cultured at 30° C. for three days and further maintained at 37° C. until day 12 by RFLP assay. The average and SEM (n=3) is shown. Panel b) Introgression of myostatin C313Y into Wagyu fibroblasts. The C313Y missense mutation is caused by a G-A transition (indicated by oversized text) at nucleotide 938 of *bovine* myostatin The HDR template also includes a T to C transition (circled) to introduce a novel EcoRI site for RFLP screening. Two left TALENs were designed against the locus, btGDF83.6-G, targeting the wild type alelle (Wt), and btGDF83.6-A targeting the mutant allele (C313Y); both share a common right TALEN. Transfection, culture and measurement were conducted as above. The average and SEM for btGDF83.6-G (n=30) and btGDF83.6-A (n=5) represent twelve and three biological replicates, respectively. A two-sided student's t-test was used to compare averages between groups; the p values are indicated.

Example 34: SNPs

FIG. 42 is a plot that shows results for sequence analysis of TALEN stimulated HDR alleles. PCR amplicons flanking the target site (200-250 bp total) derived from TALEN mRNA and oligo transfected cell populations were sequenced by ILLUMINA sequencing. Total read count ranged from 10,000 328 to 400,000 per sample. The count of perfect, intended HR reads versus the wild type reads is plotted for insertion (panel a) and SNP alleles (panel b). The target locus, time point and whether or not BMs were included in the oligo are indicated below. Panel c). Reads from btGDF8 and p65 were sorted for incorporation of the target SNP and then classified intended (iSNP) versus those with an additional mutation (iSNP+Mut) and plotted against the total number of reads.

Example 35: Sequence Analysis of HDR Alleles

Referring to FIG. 43, sequencing reads containing the correct insertion (Panel a) or SNP allele (Panel b) were analyzed for incorporation of BM. The target locus, time point and whether or not BMs were included in the oligo are indicated below each graph. In general, the 5' BM was incorporated most frequently into the HDR conversion tract, followed by inclusion of both BMs, or the 3' BM only. The distribution of BM is somewhat skewed towards incorporation of both BM when the intended mutation to LDLR is a SNP versus a 4 bp insertion allele. It is also interesting to note that the majority of intended reads for btGDF8 have incorporated at least one BM, but seldom have the 3' BM alone. Thus, while BM did not have a significant impact on the frequency of maintaining the intended SNP (iSNP) allele in culture, their enrichment relative to other loci suggests that they might have offered some protection from TALEN re-cleavage. c). The data of FIG. 42 panel c was further classified by mutation type and compared. Some reads contained only the iSNP, others had a concomitant indel (iSNP+indel), or a concomitant unintended SNP (iSNP+uSNP). There appears to be some elevation in the frequency of iSNP+indel when BMs were not included in the template, and the majority of indels were located in the spacer region so are likely to be the result of re-cutting of already converted alleles.

Example 36: Multiple SNPs in the TALEN DNA-Binding Site Stabilize HDR Alleles

Referring to FIG. 44, the EIF4GI gene was stabilized with multiple SNPs in the TALEN DNA binding site. Panel a) A portion of wild type EIF4GI Wt-NL is shown. One pair of TALENs was designed to cut the wild type EIF4GI to stimulate homologous recombination. Also aligned to the Wt sequence is the core sequence of the donor oligo, DF-HDR, used to introduce three SNPs (red oversized letters) into the genome. The third SNP creates a novel EagI restriction site that was used for RFLP analysis. Pig fibroblasts were transfected with EIF4GI14.1 TALEN mRNA (2 µg) and DF-HDR (2 µM) and then cultured at 30° C. for 3 days prior to analysis and colony propagation. Panel b) RFLP analysis on population three days post transfection. Expected product sizes of 344, 177 and 167 bp are indicated by filled triangles. Panel c) RFLP assay on isolated cellular clones. Day 3 cells were used to derive monoclonal colonies through dilution cloning. An example of colonies with heterozygous (open triangles) or homozygous (filled triangles) HDR alleles are indicated.

Example 37: Hypothermic Treatment for Maintenance of SNP HDR Alleles

Referring to FIG. 45, pig fibroblasts were transfected with TALEN mRNA (1 µg) and oligos (3 µM). Cells from two independent transfections were pooled for each replicate and evenly distributed into six wells of a 6-well plate and cultured at 30° C. Samples were collected from these populations for RFLP analysis on days 1-7 (minus day 6, 1D to 7D along X-axis) post-transfection and the remaining cells were transferred to 37° C. Samples for each condition were collected again at day 12 for RFLP analysis. The average HDR and SEM (n=3) is shown at the initial collection and once again at day 12.

Example 38: Intentional RVD Mismatches for Introgression of SNPs

Referring to FIG. 46, panel a) A TALEN pair (caCLPG 1.1) was designed to target the caCLPG region. Oligo driven HDR was utilized to introduce the desired Adenine to Guanine SNP (the targeted Adenine is boxed). The desired SNP allowed genotyping by a loss of an AvaII restriction site. Each TALEN monomer is indicated in shading above their respective binding locations. The N- and C-termini are indicated with N and C, respectively. b) Each allele of single-cell derived colonies that were resistant to AvaII were sequenced (only AvaII resistant alleles are shown). All of the alleles that contained our SNP or interest (boxed) also contained deletions (marked with dashes in the AvaII Resistant Allele sequences) or insertions (marked with dashes in the WT sequence). c) To reduce the possibility of re-binding, and subsequently re-cutting, intentional mismatches (italicized circled text) were introduced into the RVD sequence. The mismatches were placed in the RVDs directly before and/or after the RVD that would bind to the desired SNP (boxed) in right monomer of the TALEN. d) TALEN activity was measured via a Cell assay. The percent of non-homologous end joining (% NHEJ) was equivalent for 1.1 and 1.1b (28%), but was greater than 1.1 for 1.1a and 1.1c (30% and 31% respectively). The no-RNA negative control showed no TALEN activity (0%). e) Both alleles of AvaII-resistant single-cell derived colonies produced with caCLPG 1.1c were sequenced. The desired SNP is boxed. Colony 37 and 78 were heterozygous for the desired SNP and showed no additional indels. Colony 142 was homozygous for the desired SNP, but contained a 4 bp insertion on one allele.

Example 39: Mismatch Required for SNP Introgression

Referring to FIG. 47, a mismatch was required for SNP introgression. A schematic of the *bovine* DGAT sequence around K323A. The grey arrows represent the TALEN monomers where they bind to the DGAT sequence. The left arm consists of 16 RVDs, the right arm consists of 15 RVDs, and the spacer is 16 base pairs long. The GC and ggagct, boxed, are the targeted base pairs. The DGAT oligo converts the GC to an AA to create the desired DGAT mutant. As a marker for HDR, the boxed GGGAGC is converted to AAGCTT that creates a novel HindIII restriction site. Since this change is in the spacer, it should not affect TALEN binding as to not interfere with the intentional mismatch results. b) DGAT TALEN RVD sequences. btDGAT 14.2 contains no intentional mismatches in the RVDs. btDGAT 14.4, 14.5, and 14.6 each contain one intentional RVD mismatch at either position 1, 3, or 5 of the left TALEN monomer (circled). c) Bovine fibroblasts were transfected with 1 ug of talen and 0.4 nmoles of oligo. Three days after transfection cells were lysed, the DGAT sequence was amplified by PCR, digested with HindIII and ran on an acrylamide gel. The percent efficiency of HDR was determined by densitometry (HR). d) Sequence analysis of colonies produce with the original 14.2 TALENs. Of twelve colonies, none that were positive for the HindIII RFLP contained the desired mutation due to indels overlapping the site. e) Colonies derived from TALENs 14.5 and 14.6 produced the correct DGAT mutation and HindIII restriction site. These two TALEN pairs produced a total of two homozygous (HH) and three heterozygous (Hh) colonies. TALEN 14.4 did not produce any colonies with the correct DGAT mutation (data not shown).

Example 40: All-in-One TALEN-HDR/Cre-RMCE

FIG. 48 depicts a process of TALEN-HDR/RMCE. The foxed cassette is transfected along with TALENs compatible with the oligo, the loxP oligo and a source of Cre recombinase. For this process to work, TALENs must cut the target loci followed by repair with the loxP oligo prior to Cre-mediated RMCE into the repaired site. The bar graph shows the number of puromycin resistant colonies produced by this method when YFC-Cre versus mCherry was included in the transfection. To confirm targeting to the SRY locus, PCR was conducted across the predicted junction (as indicated) will result in a 370 bp product. This product is apparent only when Cre is included. For this set of experiments, the following conditions were used: 600,000 cells transfected with 1 ug SRY TALENs+0.3 nMol of SSCY_LoxP oligo+ CLP-YFP-Cre (0.5 ug)+Floxed PTK (2 ug). The negative control had 0.5 ug of mCherry plasmid in place of CLP-YFP-Cre. SSCY_LoxP oligo:

```
                                       (SEQ ID NO: 320)
TTTTATATACATTTTACACACATATATATGAAACATAACTTCGTATAGGA

GACTTTATACGAAGTTATGGATCCAAGCTTATAACTTCGTATAATGTATG

CTATACGAAGTTATTGACAGTATTAATGGCCTGAACCTAGCCAGAACT
```

Example 41: Confirmation of Belgian Blue Introgression by Sequencing

Figure 50:
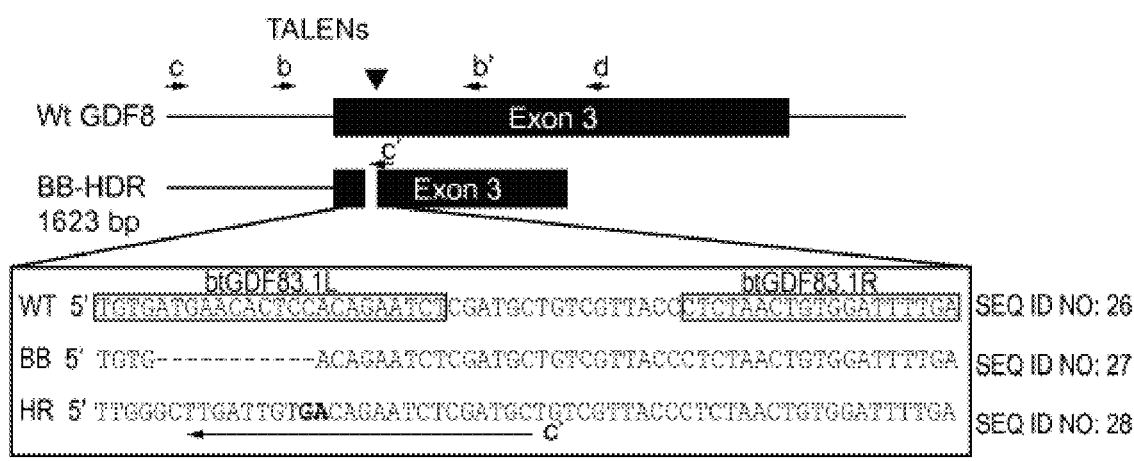
FIG. 50: Confirmation of Belgian Blue introgression by sequencing. The schematics of Wagyu wild-type GDF8 and the Belgian Blue template (BB-HDR) are shown. PCR was conducted using primers located outside of the homology arms (c and d) on five PCR positive colonies followed by cloning and sequencing with primer b'. Comparison to the wild-type sequence revealed the expected 11-basepair deletion characteristic the Belgian Blue allele (heterozygous) in 4 of 5 colonies.
Figure 51:
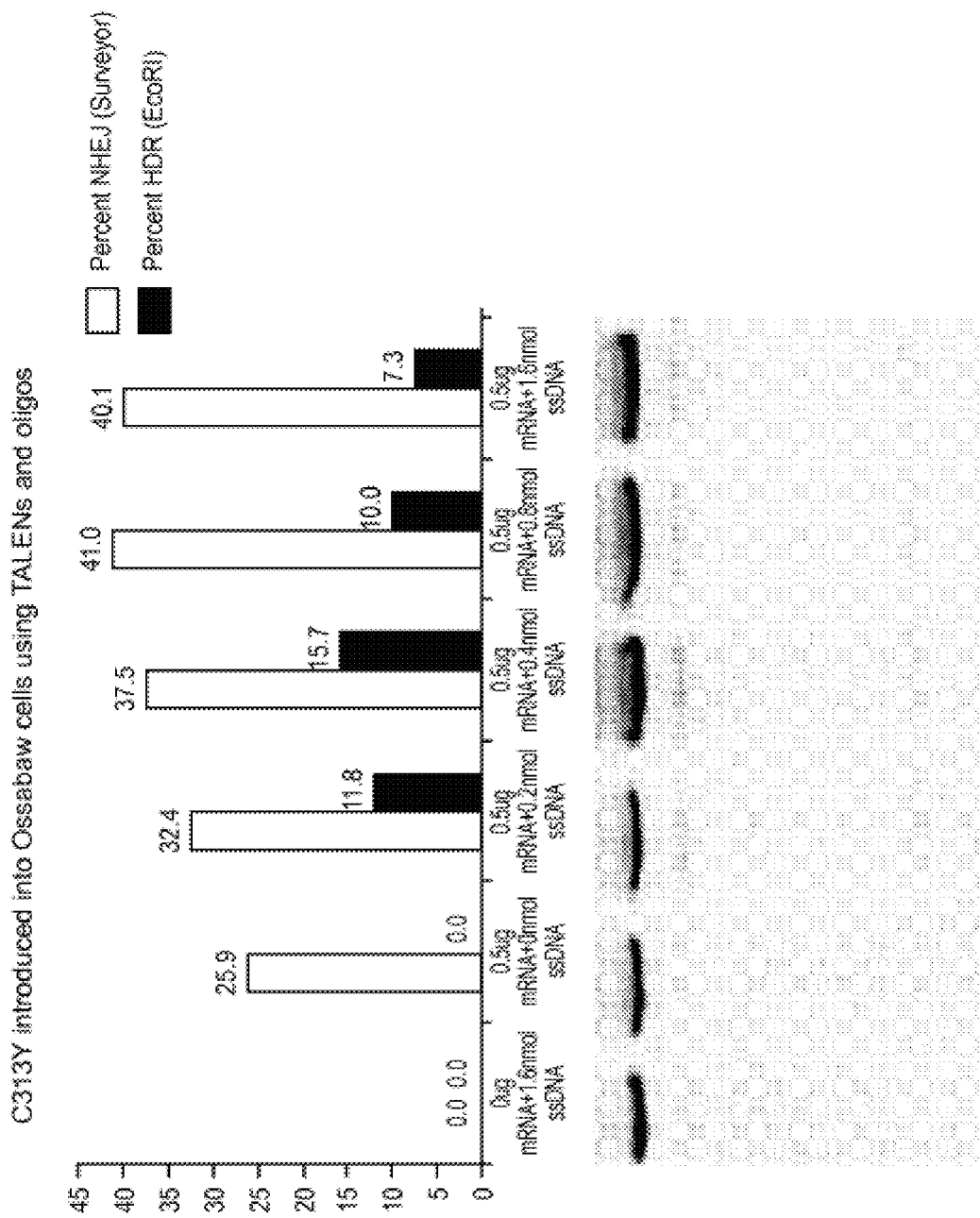
FIG. 51: Introgression of naturally occurring alleles from one species to another using mRNA encoded TALENs and ssODNs. The Piedmontese Myostatin allele C313Y was introgressed into Ossabaw.

The schematics of Wagyu wild-type GDF8 and the Belgian Blue template (BB-HDR) are shown in FIG. 50. PCR was conducted using primers located outside of the homology arms (c and d) on five PCR positive colonies followed by cloning and sequencing with primer b'. Comparison to the wild-type sequence reveals the expected 11-basepair deletion characteristic the Belgian Blue allele (heterozygous) in 4 of 5 colonies. TALENs (btGDF83.1, SEQ ID NOS:428 and 431) and a dsDNA template (BB-HDR) were designed to introduce an 11-basepair deletion into exon-3 of bovine GDF8 (Belgium Blue mutation) by double-strand break-induced homologous recombination. (SEQ ID NO: 504) Half of the binding site for the left TALEN is missing in the BB-HDR template and thus should be resistant to TALEN cleavage. SURVEYOR assay demonstrated activity of btGDF83.1 TALENs at both 37 and 30° Celsius. Allele-specific PCR demonstrated that HDR induction was dependent on co-transfection of TALENs and the BB-HDR template. The PCR assay was developed to specifically detect HDR modified GDF8 alleles using primers c and c'. The 3' end of primer c' spans the 11-basepair deletion, and cannot amplify the wild type allele (wt). Five hundred cell equivalents were included in each PCR reaction including the positive control. Percent HDR was determined by comparative densitometry between experimental and control reactions.

Example 42: Precision Alteration of Intended Gene in Wild-Type Wagyu Cattle

A gene of wild-type Wagyu cattle was altered by making a deletion in a targeted area of the gene (an 11 bp deletion) in Wagyu fibroblasts as can be seen in FIG. 50. This alteration made the Wagyu cattle have the allele of Beligan Blue cattle. When transfected alone, the btGDF8.1 TALEN pair (SEQ ID NO: 428 and 431) cleaved up to 16% of chromosomes at the target locus. TALENs (btGDF83.1) and a dsDNA template (BB-HDR) were designed to introduce an 11-bp deletion in exon-3 of bovine GDF8 (Belgium Blue mutation) by DSB induced homologous recombination. (SEQ ID NO: 504) Half of the binding site for the left TALEN was missing in the BB-HDR template, to make it resistant to TALEN cleavage. A SURVEYOR assay demonstrated activity of btGDF83.1 TALENs at both 37 and 30° Celsius. The PCR product used for this assay was generated using primers b and b' (not shown). The BB-HDR template was not included in these replicates since it would confound estimates of btGDF83.1 activity. Allele specific PCR demonstrated that HDR induction was dependent on co-transfection of TALENs and the BB-HDR template. The PCR assay was developed to specifically detect HDR modified GDF8 alleles using primers c and c' (not shown). The 3' end of primer c' spanned the 11-bp deletion so that it could not amplify the wild type allele "wt". Five hundred cell equivalents were included in each PCR reaction including the positive control "C". Percent HDR was determined by comparative densitometry between experimental and control reactions. Co-transfection with a supercoiled DNA template harboring a 1623 bp DNA fragment from Belgian Blue cattle resulted in a gene conversion frequency (HDR) of 0.5% to 5% as suggested by semi-quantitative PCR at day 3, without selection for the desired event. These results demonstrated that TALENs can be used to effectively place exogenous nucleic acid sequences in livestock, including alleles—and without markers. To assess the frequency of placement in individual colonies, the transposon co-selection strategy was implemented to isolate and expand individual colonies for DNA sequencing. Gene conversion using template from Belgian Blue cattle was detected in 5 colonies out of 366 examined by PCR. Amplification with primers outside the Belgian Blue HDR template and sequencing confirmed the presence of the expected 11 bp deletion in 4 of the colonies.

A second repeat experiment was performed with consistent results, with about 1% of all tested colonies being positive for bi-allelic conversion and about 0.5% to about 1% of all tested colonies being heterozygous for allele conversion.

Similarly, alleles were also introduced into pig (Ossabaw) cells using oligo HDR. The cells were modified with a combination of mRNA encoded TALENs and single-stranded oligonucleotides to place an allele that occurs naturally in one species to another species (interspecific migration) as can be seen in FIG. 51. Piedmontese GDF8 SNP C313Y, were chosen as an example and was introduced into Ossabow swine cells. No markers were used in these cells at any stage. A similar peak in HDR was observed between pig and cattle cells at 0.4 nmol ssODN, (not shown) however, HDR was not extinguished by higher concentrations of ssODN in Ossabaw fibroblasts. (SEQ ID NOS: 444, 445 and 507)

Example 43: Modification at Intended Targets

Figure 52:
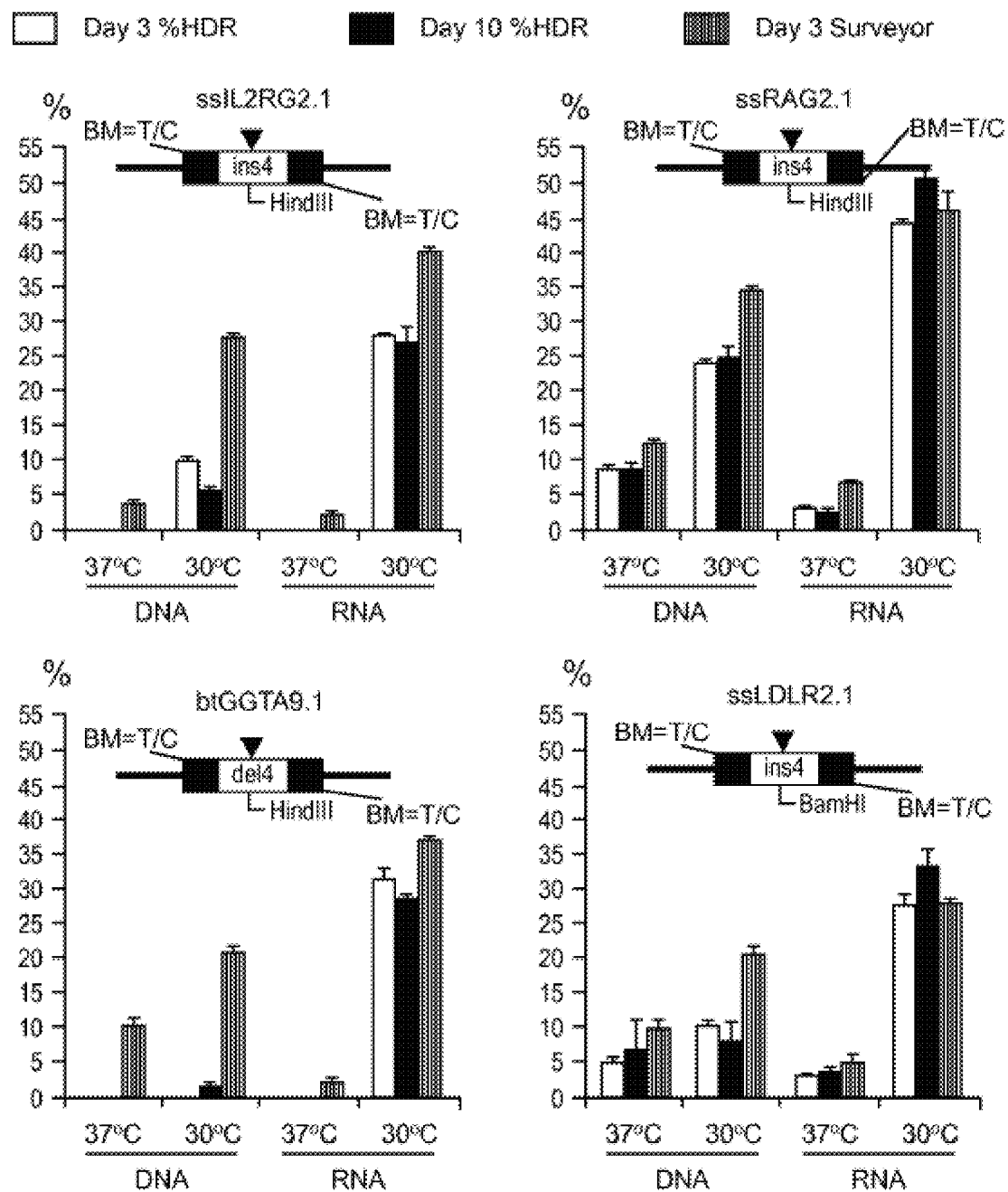
FIG. 52: Modification of targeted genes. Each chart displays results of targeting a specific locus in fibroblasts (e.g., ssIL2RG; "ss" for *Sus scrofa* and "bt" for *Bos taurus*). (Insets) Diagrams of the oligo templates, in which the shaded boxes represent the TALEN-binding site and the spacers are shown in white. HDR was measured at days 3 and 10 by RFLP analysis (Day3% HDR and Day10% HDR). Each bar displays the average and SEM from three replicates.

Consistent modification of targeted genes was made. Referring to FIG. 52, each chart displays results of targeting a specific locus in fibroblasts (e.g., ssIL2RG; "ss" for Sus scrofa and "bt" for Bos taurus) using oligo donor templates and TALENs delivered as plasmid DNA or mRNA. (Insets) Diagrams of the oligo templates, in which the shaded boxes represent the TALEN-binding site and the spacers are shown in white. Each oligo contains either a 4-bp insertion (ins4) or deletion (del4) that introduces a novel restriction site for RFLP analysis, see Table 15 below. (SEQ ID NOS: 508-513) Presumptive blocking mutations (BM) replace the conserved −1 thymidine (relative to the TALEN-binding site) with the indicated nucleotide. Fibroblasts were transfected with either TALEN-encoding plasmids (3 µg) or mRNA (1 µg) along with 3 µM of their cognate oligo-homologous template. Cells were then incubated at 37° C. or 30° C. for 3 d before expansion at 37° C. until day 10. TALEN activity was measured by the Surveyor assay at day 3 (Day3 Surveyor), and HDR was measured at days 3 and 10 by RFLP analysis (Day3% HDR and Day10% HDR). Each bar displays the average and SEM from three replicates. Each of the targeted loci was successfully modified. The TALEN pairs used were ssILRG2.1 (SEQ ID NOS: 484 and 485); ssRAG2.1 (SEQ ID NOS:488 and 489); btGGTA9.1 (SEQ ID NOS:490 and 491); and ssLDLR2.1 (SEQ ID NOS:438 and 439).

Example 44: High Efficiency for Making Intended Changes in Genes

Figure 53:
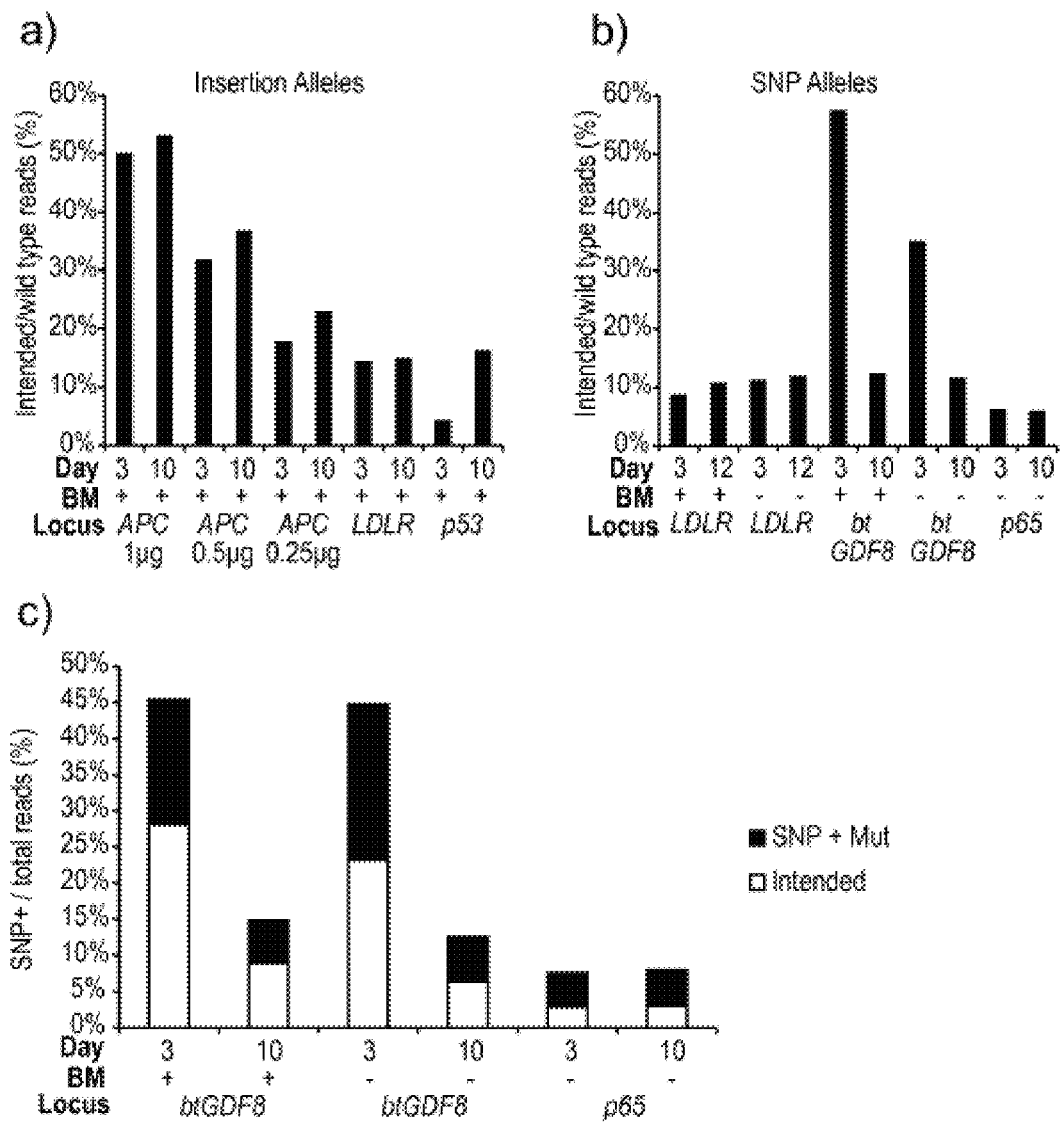
FIG. 53: Sequence analysis of TALEN stimulated HDR alleles. PCR amplicons flanking the target site (200-250 bp total) derived from TALEN mRNA and oligo transfected cell populations were sequenced by ILLUMINA sequencing. Total read count ranged from 10,000 to 400,000 per sample. The count of perfect, intended HR reads versus the wild type reads is plotted for insertion (panel a) and SNP alleles (panel b). The target locus, time point and whether or not BMs were included in the oligo are indicated below. Panel c). Reads from btGDF8 and p65 were sorted for incorporation of the target SNP and then classified intended (iSNP) versus those with an additional mutation (iSNP+Mut) and plotted against the total number of reads.

FIG. 53 shows analysis of changes made to genes APC (SEQ ID NOS:482 and 483), LDLR (SEQ ID NOS:438 and 439), p53 (SEQ ID NOS:452 and 453), p65 (SEQ ID NOS:440 and 441), and btGDF8 (SEQ ID NOS:428 and 431) (TALEN pairs shown in parentheses). FIG. 53 shows three graphs: (a) shows data from pig fibroblasts, (b) shows data from pig fibroblasts (LDLR, p65) and cattle fibroblasts (DGF8), and (c) shows data from pig fibroblasts (p65) and cattle fibroblasts 9GDF8). In some cases insertions were intended, while SNPs were intended in other cases. Changes were made with TALENs and HDR templates, as described above. Table 15, above, lists the HDR templates. (SEQ ID NOS: 509-511 and 514-518) The count of perfect, intended HR reads versus the wild type reads is plotted for: insertion (panel a) and SNP alleles (panel b). Sequence analysis of TALEN stimulated HDR alleles was made. PCR amplicons flanking the target site (200-250 bp total) derived from TALEN mRNA and oligo transfected cell populations were sequenced by ILLUMINA sequencing. Total read count ranged from 10,000 to 400,000 per sample. The target locus, time point and whether or not BMs were included in the oligo are indicated below. Panel c shows reads from btGDF8

TABLE 15

Oligonucleotide HDR templates

| TALEN pair | FIG./ panel | ssODN design | Sequence |
|---|---|---|---|
| ssLDLR2.1 | | 46_SNPs BamHI | CCTACAAGTGGATTTGTGGGATCCACACCGAGTGCAA GGACGGGTC (SEQ ID NO: 508) |
| ssLDLR2.1 | 53B | 90_SNPs BamHI | TGCCGAGACGGGAAATGCATCTCCTACAAGTGGATTT GTGGGATCCACACCGAGTGCAAGGACGGGTCCGATG AGTCCCTGGAGACGTGC (SEQ ID NO: 509) |
| ssLDLR2.1 | 53A | 90_ins4_BM BamHI | CCGAGACGGGAAATGCACCTCCTACAAGTGGATTTGT GATGGATCCGAACACCGAGTGCAAGGACGGGTCCGC TGAGTCCCTGGAGACGT (SEQ ID NO: 510) |
| ssLDLR2.1 | 53B | 90_SNPs_BM BamH1 | TGCCGAGACGGGAAATGCACCTCCTACAAGTGGATTT GTGGGATCCACACCGAGTGCAAGGACGGGTCCGCTG AGTCCCTGGAGACGTGC (SEQ ID NO: 511) |
| ssLDLR2.1 | | 60_SNPs_BM BamH1 | TGCACCTCCTACAAGTGGATTTGTGGGATCCACACCG AGTGCAAGGACGGGTCCGCTGAG (SEQ ID NO: 512) |
| ssLDLR2.1 | | 86_del4_BM BamH1 | TGCCGAGACGGGAAATGCACCTCCTACAAGTGGATTT GGGATCCACCGAGTGCAAGGACGGGTCCGCTGAGTC CCTGGAGACGTGC (SEQ ID NO: 513) |
| ssAPC14.2 | 53A | 90_ins4_BM HindIII | CCAGATCGCCAAAGTCACGGAAGAAGTATCAGCCAT TCATCCCTCCCAGTGAAGCTTACAGAAATTCTGGGTC GACCACGGAGTTGCACT (SEQ ID NO: 514) |
| ssTp53 | 53A | 90_ins5_BM HindIII | AGCTCGCCACCCCCGCCGGGCACCCGTGTCCGCGCCA TGGCCATCTAAGCTTAAAGAAGTCAGAGTACATGCCC GAGGTGGTGAGGCGCT (SEQ ID NO: 515) |
| btGDF83. 6-G | 53B | 90_SNPs_BM EcoRI | CTAAAAGATATAAGGCCAATTACCGCTCTGGAGAATA TGAATTCGTATTTTTGCAAAAGTATCCTCATCCCCATC TTGTGCACCAAGCAA (SEQ ID NO: 516) |
| btGDF83. 6-G | 53B | 90_SNP | CTAAAAGATATAAGGCCAATTACTGCTCTGGAGAATA TGAATTTGTATTTTTGCAAAAGTATCCTCATACCCATC TTGTGCACCAAGCAA (SEQ ID NO: 517) |
| ssP65.8 | 53B | 90_SNP XmaI | GGGCCTCTGGGCTCACCAACGGTCTCCTCCCGGGGGA CGAAGACTTCTCCTCCATTGCGGACATGGACTTCTCA GCCCTTCTGAGTCAGA (SEQ ID NO: 518) | and p65, as sorted for incorporation of the target SNP and then classified intended (iSNP) versus those with an additional mutation (iSNP+Mut) and plotted against the total number of reads. Accordingly, in the case where only a single SNP was intended, there were also additional changes, as indicated.

Example 45: Frequencies for Recovery of Colonies with HDR Alleles

Table 7, entitled Frequencies for recovery of colonies with HDR alleles, lists the results of an analysis of about 650 colonies of cells for intended indel alleles in eight separate loci. The analysis revealed a recovery rate of 10-64% (average, 45%), with up to 32% of the colonies homozygous for the edit. Changes were made with TALENs and HDR templates, as described above. The colonies were obtained by dilution cloning without drug selection.

Example 46: Cloned Pigs with HDR Alleles of DAZL and APC

Figure 54:
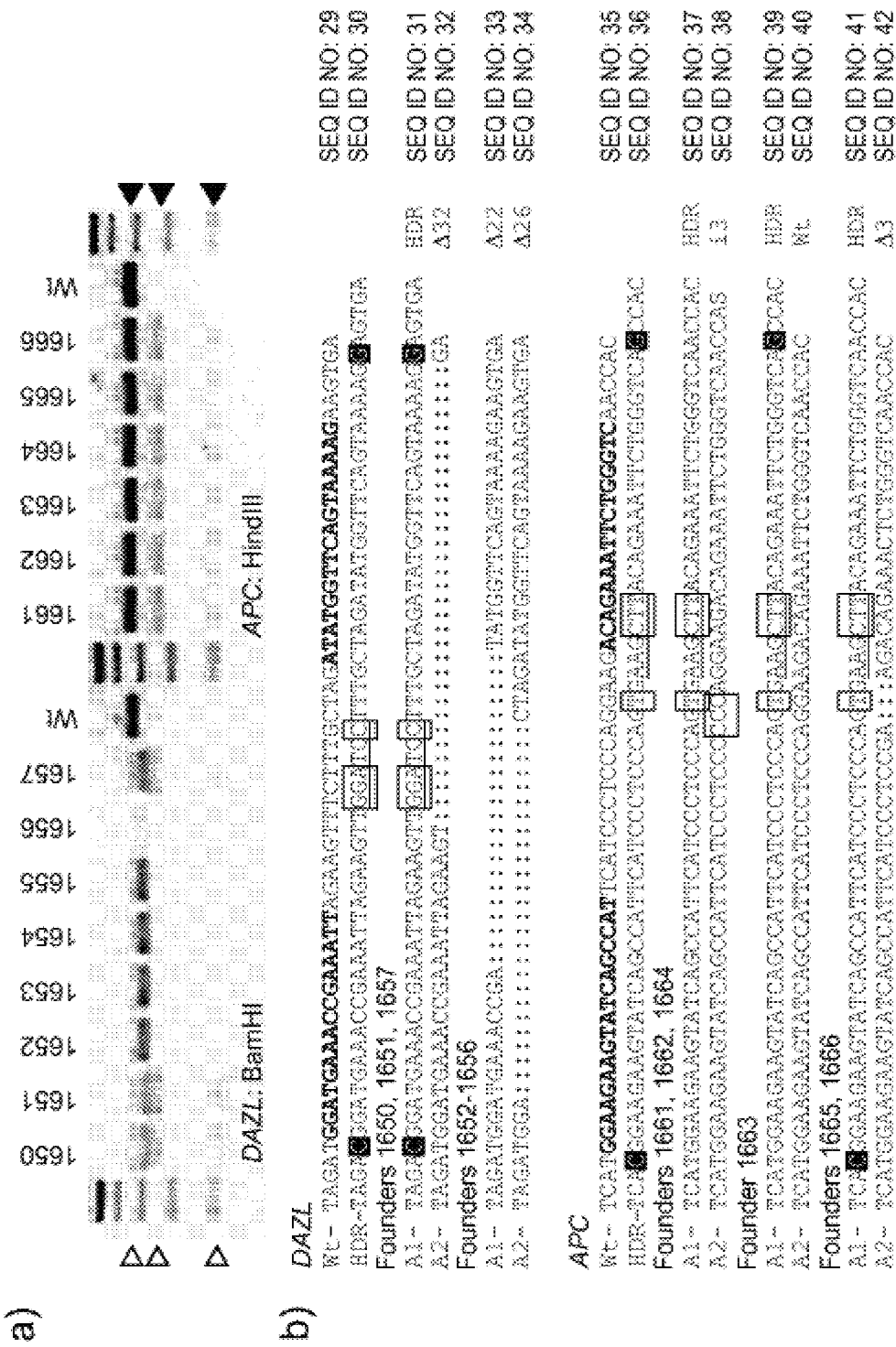
FIG. 54: Cloned pigs with HDR alleles of DAZL and APC. (A) RFLP analysis of cloned piglets derived from DAZL- and APC-modified landrace and Ossabaw fibroblasts, respectively. Expected RFLP products for DAZL founders are 312, 242, and 70 bp (open triangles), and those for APC are 310, 221, and 89 bp (filled triangles). The difference in size of the 312-bp band between WT and DAZL founders reflects the expected deletion alleles. (B) Sequence analysis confirming the presence of the HDR allele in three of eight DAZL founders, and in six of six APC founders. BMs in the donor templates (HDR) are indicated with arrows, and inserted bases are enclosed in blocks. The bold text in the top WT sequence indicates the TALEN-binding sites.

FIG. 54 shows a genetic analysis of cloned animals. Two gene-edited loci in the porcine genome, deleted in azoospermia-like (DAZL, SEQ ID NOS: 182-183) and adenomatous polyposis coli (APC, SEQ ID NOS:188-189) were chosen. Colonies of cultured cells treated with HDR- or NHEJ edited alleles of DAZL or APC were pooled for cloning by chromatin transfer (CT). Each pool yielded two pregnancies from three transfers, of which one pregnancy each was carried to term. A total of eight piglets were born from DAZL-modified cells, white composite pig fibroblasts, each of which reflected genotypes of the chosen colonies consistent with either the HDR allele (founders 1650, 1651, and 1657) or deletions resulting from NHEJ (FIG. 53A, FIG. 54). Three of the DAZL piglets (founders 1655-1657) were stillborn. Of the six piglets from APC-modified cells, one was stillborn, three died within 1 wk, and another died after 3 wk, leaving only founder 1661 alive. The lack of correlation between genotype and survival suggests that the early deaths were related to cloning rather than to gene edits. All six APC piglets were heterozygous for the intended HDR-edited allele, and all but one piglet had either an in-frame insertion or deletion of 3 bp on the second allele (FIGS. 54 A and B) in Ossabaw pig fibroblasts. The remaining animals are being raised for phenotypic analyses of spermatogenesis arrest (DAZL-/- founders) or development of colon cancer (APC+/- founders). Referring to FIG. 6, (a) RFLP analysis of cloned piglets derived from DAZL- and APC-modified landrace and Ossabaw fibroblasts, respectively. Expected RFLP products for DAZL founders are 312, 242, and 70 bp (open triangles), and those for APC are 310, 221, and 89 bp (filled triangles). The difference in size of the 312-bp band between WT and DAZL founders reflects the expected deletion alleles. (b) Sequence analysis confirming the presence of the HDR allele in three of eight DAZL founders, and in six of six APC founders. BMs in the donor templates (HDR) are indicated with arrows, and inserted bases are enclosed in blocks. The bold text in the top WT sequence indicates the TALEN-binding sites.

Example 47: GPR54 Knockout

Figure 55:
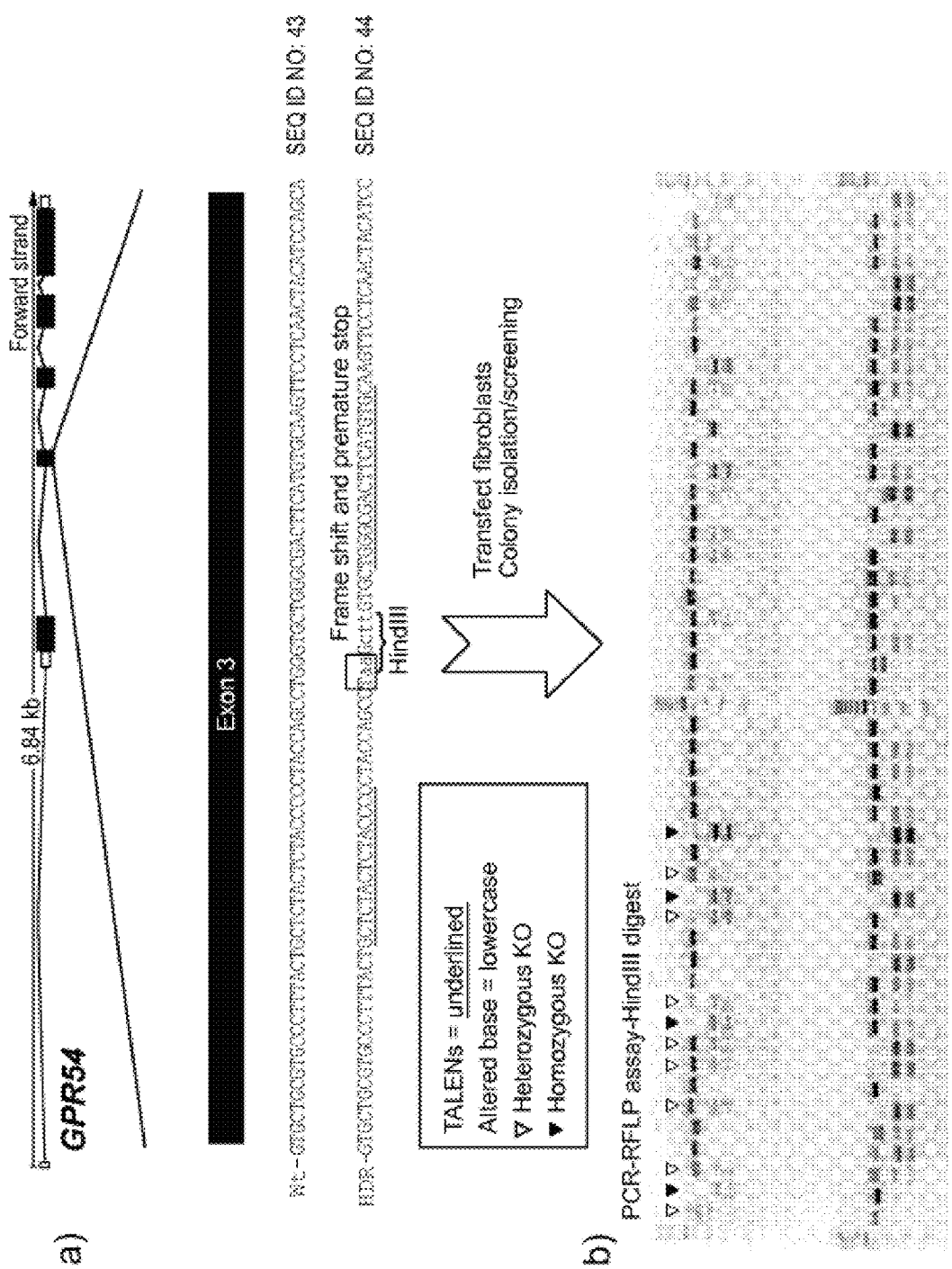
FIG. 55: A schematic of porcine GPR54 and the gene targeting strategy for knockout is depicted in panel a. TALENs designed to bind exon 3 (underlined text) were co-transfected with an oligonucleotide homology template (HDR) designed to introduce a premature stop codon and a HindIII restriction site.
Figure 81:
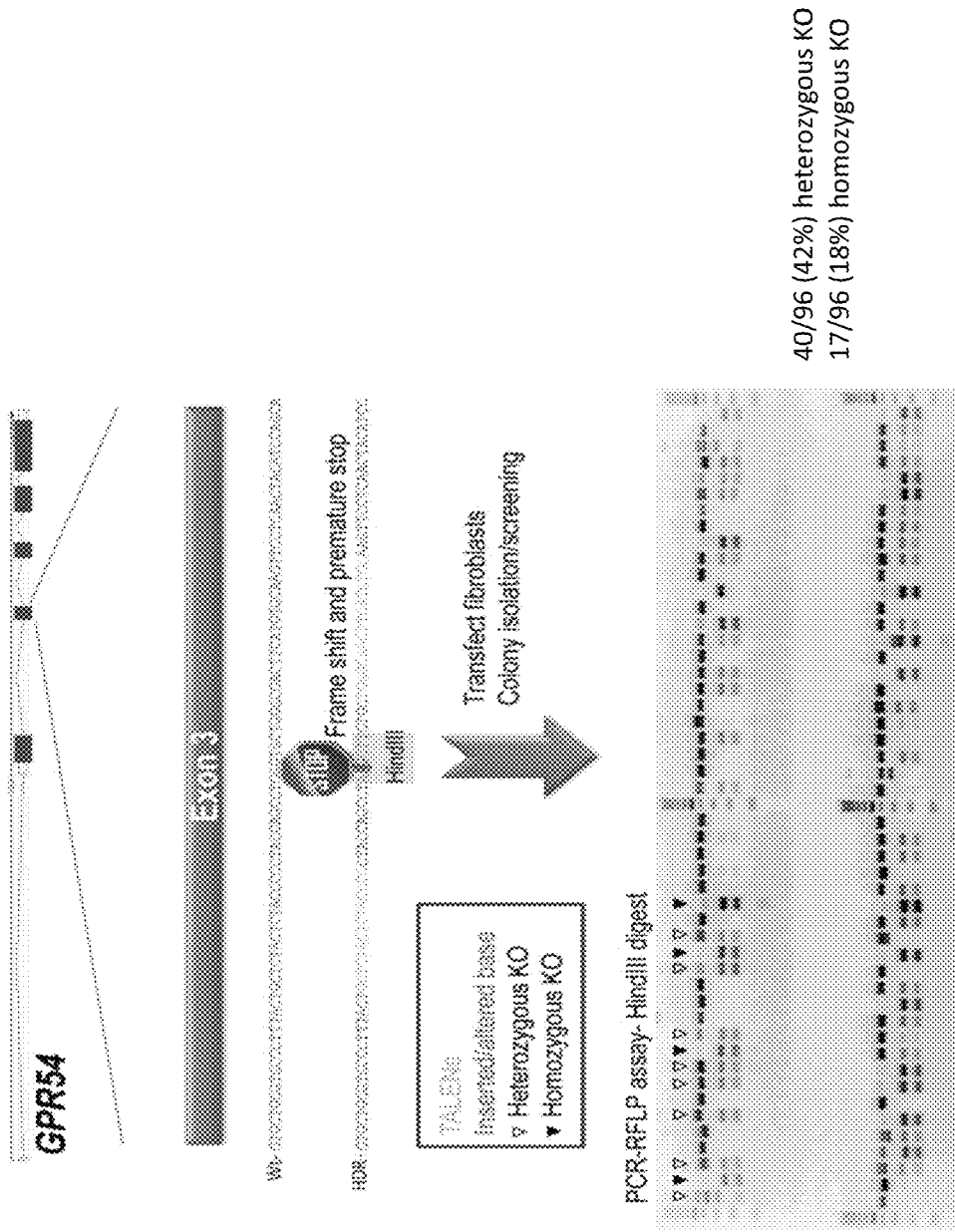
FIG. 81: Development of a gene edit cell line of GPR54 knock out pig fibroblasts. A PCR-RFLP assay was run to confirm that a frame shift and premature stop codon were successfully integrated into Exon 3 of the GPR54 gene using TALENS.

FIG. 55 depicts GPR54 (SEQ ID NO: 196) knockouts, made according to the indicated gene targeting strategy. TALENs designed to bind porcine exon 3 (underlined text in SEQ ID NO: 197, 492 and 493) were co-transfected with an oligonucleotide homology template (HDR) designed to introduce a premature stop codon (boxed) and a HindIII restriction site. For the experimental results shown in panel b, 2 micrograms of TALENs encoding mRNA (SEQ ID NO: 519) plus 0.2 nMol (2 uM) of the HDR template were transfected into pig fibroblasts 500,000 pig fibroblasts using the NEON nucleofection system (Life Technologies) with the following settings: 1 pulse, 1800 v; 20 ms width and a 100 ul tip. The cells were grown at 30° C. for three days after exposure to TALENs and cells were enumerated and plated at a range of densities 1-20 cells/cm2 on 10 cm dishes. Cells were cultured for 10-15 days until individual colonies of 3-4 mm in diameter could be observed. Colonies were aspirated with a p-200 pipettor under gentle aspiration and expelled into a well of 24-well plate with 500 ul of growth medium (Carlson, 2011). Plates with clearly defined colonies (~10-30/plate) were chosen for colony aspiration to limit the chance of aspirating cells from multiple colonies. Once a colony reached 70-90 percent confluent in the 24-well dish, a portion was harvested for RFLP analysis and the remainder was cryopreserved. panel b) A total of 96 colonies were analyzed for homology dependent repair by HindIII RFLP assay. DNA from each colony was added to a PCR reaction that included PCR primers flanking the target site; forward (5'-aaggatgtcagcacctctctggg (SEQ ID NO: 159)) and reverse (5'-ACCCACCCGGACTCTACTCCTACCA (SEQ ID NO: 160)). PCR products (389 bp) were added to a HindIII restriction digest and resolved on a 2.5% agarose gel. Each lane represents one colony (see FIG. 81). Cleavage products of 231 and 158 bp are indicative of homology dependent repair. Colonies with the parent band of 389 bp are classified as heterozygous (open triangle) and those without are classified as homozygous (filled triangle) for the HDR, knockout allele. Cells prepared by this technique were used to clone pigs using customary techniques (see Example 48). Indeed, GPR54 knockout pigs were born through somatic cell nuclear transfer. Underdeveloped testes were apparent in 6-12 month old male pigs, and such pigs did not exhibit boar taint. Rather, such pigs acted like barrows, with little to no aggression observed.

Example 48: Creation of Livestock that do not Mature without Treatment

Livestock with GPR54 knockout(s) can be prepared, including cattle, pig, and chicken. The preceding example details one such process. The following specific methods are described for pigs; artisans will be able to adapt the experiments to other livestock after reading this application. TALENs for Gpr54 (SEQ ID NO: 196) were developed and used to generate heterozygous and homozygous knockout cell lines (SEQ ID NO: 197, 492 and 493). Analysis of the colony isolation and screening can be seen in FIG. 81. Pregnancy was established using male and female Gpr54-/- and/or cell lines heterozygous for Gpr54+/- with Gpr54-/- animals generated by intercross. The development and fertility of Gpr54-/- animals was evaluated. The already-demonstrated ability to generate efficient TALENs, isolate mutant colonies and produce transgenic animals from cells or zygotes has been well documented herein, see also Tan et al., PNAS, 110(41): 16526-16531, 2013.

Figure 82:
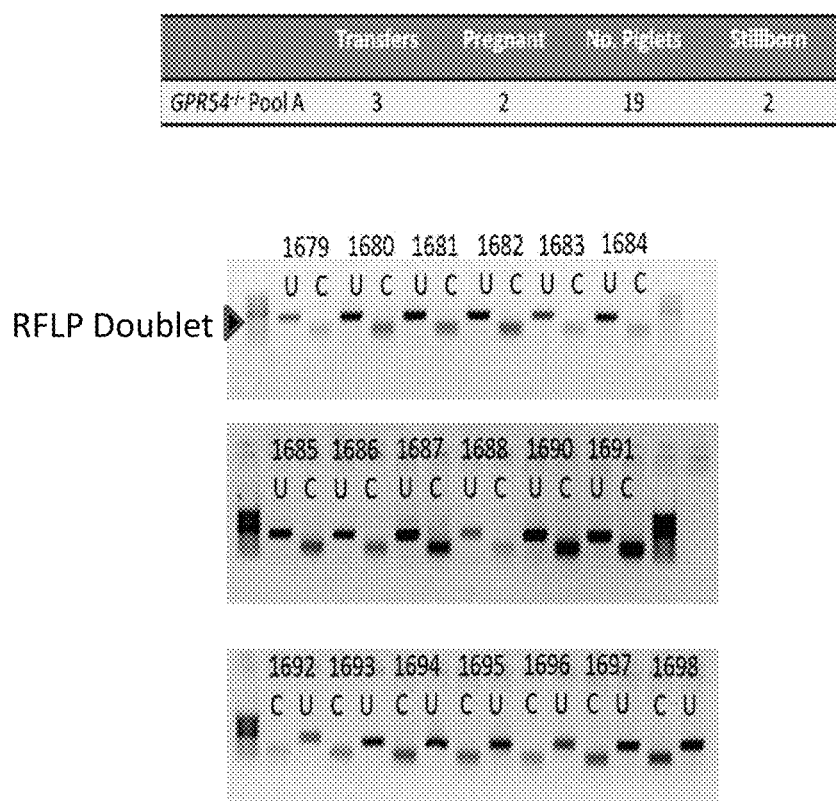
FIG. 82: Confirmation of the GPR54 knockout from FIG. 81 in pig embryos produced by somatic cell transfer and grown to piglets after impregnanton within sows.

Generation of Gpr54-/- male and female pigs. Ten bi-allelic KO male and female clones, as generated in Example 10 through somatic cell nuclear transfer (SCNT), harboring frame shift mutations of both alleles were pooled for cloning by SCNT. Two rounds of cloning (3 transfers each) were conducted. Three transfers were performed and two sows were impregnated. A total of 19 piglets were born alive and two were stillborn. Genotypes of the resulting animals were characterized by sequencing of the targeted region of Gpr54 as can be seen in FIG. 82. Because Gpr54+/− cells were used for cloning, Gpr54−/− animals were generated by intercross.

Phenotypic evaluation of Gpr54−/− pigs. Serum levels of testosterone and FSH (≥3 per sex) were quantified every two weeks for Gpr54−/− animals and age-matched controls beginning at 5 months and continuing to 9 months of age. For males, testicular size was measured and plotted against body weight and age. Underdeveloped testes were apparent in 6-12 month old male pigs. No boar-taint odor was present and they acted like barrows in that little to no aggression was observed in the animals.

Example 49: CRISPR/Cas Mediated HDR

CRISPR gRNAs that overlapped the T1591C site of p65 were made and evaluated for introgression in pig fibroblasts (target sequence identified in SEQ ID NO: 372). Efficient production of double stranded breaks (DSBs) at the intended site was observed. CRISPR/Cas9-mediated HDR was <6% at day 3 and below the limit of detection at day 10. Recovery of modified clones was lower with CRISPR-mediated HDR than with TALENs, even though the TALENs cut 35 bp away from the SNP site (Table 7). Analysis of CRISPR/Cas9-induced targeting at a second locus, sAPC14.2, was more efficient, although it did not reach the level of HDR induced by TALENs at this site (~30% vs. 60%). See also, Tan et al., PNAS, 110(41): 16526-16531, 2013). The CRISPR/Cas9 endonucleases were generated based on the Church laboratory system and methods, *Mali* P, et al. (2013) RNA-guided human genome engineering via Cas9. Science 339(6121):823-826.

TABLE 11

TALEN Sequences (left) and DNA Target Sequences for CRISPR (right).
Table 11. TALEN sequences and DNA target sequence of the TALENs

| TALEN pair | TALEN RVD sequence | DNA Target sequence, spacer underlined (Sense strand) |
|---|---|---|
| ssLDLR2.1 | HD NG HD HD NG NI HD NI NI NN NG NN NN NI<br>NG NG NG<br>HD NN NN NI HD HD HD NN NG HD HD NG NG<br>NN HD NI HD NG | CTCCTACAAGTGGATTT<u>GTGATGGGAACACCG</u>AGTGC<br>AAGGACGGGTCCG SEQ ID NO: 354 |
| btGDF83.1L + NR | NN NG NN NI NG NN NI NI HD NI HD NG HD HD<br>NI HD NI NN NI NI NG HD NG<br>NG HD NI NI NI NI NG HD HD NI HD NI NN NG NG<br>NI NN NI NN | GTGATGAACACTCCACAGAATCT<u>CGATGCTGTCGTTAC<br>C</u>CTCTAACTGTGGATTTTGA SEQ ID NO: 355 |
| ssDAZL3.1 | NN NN NI NG NN NI NI NI HD HD NN NI NI NI NG<br>NG<br>HD NG NG NG NG NI NG NN NI NI HD HD NI<br>NG NI NG | GGATGAAACCGAAATT<u>AGAAGTTTCTTTGCTAGA</u>TATG<br>GTTCAGTAAAAG SEQ ID NO: 356 |
| ssAPC14.2 | NN NN NI NI NN NI NI NN NG NI NG HD NI NN HD<br>HD NI NG<br>NN NI HD HD HD NI NN NI NI NG NG NG HD NG<br>NN NG | GGAAGAAGTATCAGCCATT<u>CATCCCTCCCAGGAAGAC</u><br>AGAAATTCTGGGTC SEQ ID NO: 357 |
| ssTp53 | NN NN HD NI HD HD HD NN NG NN NG HD HD<br>NN HD NN HD<br>HD NI NG NN NG NI HD NG HD NG NN NI HD NG<br>NG | GGCACCCGTGTCCGCG<u>CCATGGCCATCTACAAG</u>AAGT<br>CAGAGTACATG SEQ ID NO: 358 |
| ssKissR3.2 | NN HD NG HD NG NI HD NG HD NG NI HD HD HD<br>HD<br>NN HD NI HD NI NG NN NI NI NN NG HD NN HD<br>HD HD NI | GCTCTACTCTACCCCC<u>TACCAGCCTGGGTGCTGGG</u>CGA<br>CTTCATGTGC SEQ ID NO: 359 |
| ssEIF4GI14.1 | HD HD NN NG HD HD NG NG NG NN HD HD NI NI<br>HD HD NG NG<br>NG NN NN NN NN NN HD HD HD NI HD NN NN<br>NG NG NN HD NG | CCGTCCTTTGCCAACCTT<u>GGCCGACCAGCCCTT</u>AGCAA<br>CCGTGGGCCCCCA SEQ ID NO: 360 |
| btGGTA9.1 | HD NG NN HD NN NG HD HD NG NG HD NI NI<br>NI NN NG<br>NN NG HD HD NG NN HD HD NI HD HD NG HD<br>NG NG HD NG | CTGCGCTCCTTCAAAGT<u>GTTTAAGATCAAGCCTG</u>AGAA<br>GAGGTGGCAGGAC SEQ ID NO: 361 |
| ssRAG2.1 | NI HD HD NG NG HD HD NG HD HD HD HD NG<br>HD HD NN HD NG<br>HD NG NI NI NN HD NN HD NG NG NG NG NN<br>NI NI NG | ACCTTCCTCCTCTCCGCT<u>ACCCAGCCACTTGCAC</u>ATTC<br>AAAAGCAGCTTAG SEQ ID NO. 362 |
| ssIL2Rg2.1 | HD HD HD NI NI NI NN NN NG NG HD NI NN NG<br>NN NG NG NG<br>HD HD NI NI NN NG NN HD NI NI NG NG HD NI<br>NG NN NG NI HD NG | CCCAAAGGTTCAGTGTTT<u>TGTGTTCAATGTTG</u>AGTACA<br>TGAATTGCACTTGG SEQ ID NO: 363 |
| btGDF83.6-A | NN HD NG HD NG NN NN NN NI NN NI NG NI NG<br>NI NG NN NI NN NN NI NG NI HD NG NG NG NG | GCTCTGGAGAATAT<u>GAATTTGTATTTTT</u>GCAAAAGTAT<br>CCTCAT SEQ ID NO: 364 |

TABLE 11-continued

TALEN Sequences (left) and DNA Target Sequences for CRISPR (right).
Table 11. TALEN sequences and DNA target sequence of the TALENs

| TALEN pair | TALEN RVD sequence | DNA Target sequence, spacer underlined (Sense strand) |
|---|---|---|
| btGDF83.6-G | NN HD NG HD NG NN NN NI NN NI NI NG NNNG<br>NI NG NN NI NN NN NI NG NI HD NG NG NG NG | GCTCTGGAGAATGTGAATTTGTATTTTTGCAAAAGTAT CCTCAT SEQ ID NO: 365 |
| ssGDF83.6 | NI HD NG NN HD NG HD NG NN NN NI NN NI NN NG<br>NN NG NN NI NN NN NN NG NI NG NG NG NG NN NG | ACTGCTCTGGAGAGTGTGAATTTGTATTTTTACAAAAA TACCCTCAC SEQ ID NO: 366 |
| btRosa1.2 | HD NG HD NN HD NI NG NG NN HD HD HD NI HD NG<br>HD NG HD NG HD HD NI HD HD HD NG NI HD HD NG | CTCGCATTGCCCACTGGGTGGGTGCTTAGGTAGGTAGG GTGGAGAGAG SEQ ID NO: 367 |
| ssSRY3.2 | NI NG NI HD NI NG NG NG NG NI HD NI HD NI HD NI NG NI NG<br>NI NN NN NG NG HD NI NN NN HD HD NI NG NG NI NI NG | ATACATTTTACACACATATATATGAAACTGACAGTATT AATGGCCTGAACCT SEQ ID NO: 368 |
| caFecB6.1 | NI HD NI NN NI NN NN NI NN NN HD HD NI NN HD NG NN NN NG NG<br>HD NI NG HD NI NI HD NI HD HD NN NG HD NG NN NI NG NI NG | ACAGAGGAGGCCAGCTGGTTCCGAGAGACAGAAATAT ATCAGACGGTGTTGATG SEQ ID NO: 369 |
| caCLPG1.1 | NN NI NN NI NN HD NN HD NI NN NN NI NI NG HD HD NI NN NN<br>HD NG NN NI HD NI NN NN NG NN NN NG HD HD HD NI NN HD | GAGAGCGCAGGAATCCAGGCGCAGGGGCCCGAGGGCT GGGACCACCTGTCAG SEQ ID NO: 370 |
| btHP1.3 | NG NG NG HD NG NG NN NN NG NI NN NN HD NG NN<br>NN NI NI NI NI NN NI NN NI NN NG NG NG NG NN NI NG | TTTCTTGGTAGGCTGGTATTCTTGCTCTTTAGATCAAAA CTCTCTTTTC SEQ ID NO: 371 |
| ssP65_11.1 | NN HD HD HD HD HD HD HD NI HD NI HD NI NN HD NG<br>NI NG NI NN HD HD NG HD NI NN NN NN NG NI HD NG | GCCCCCCCACACAGCTGAGCCCATGCTGATGGAGTAC CCTGAGGCTAT SEQ ID NO: 372 |
| ssP65.8 | HD NG HD HD NG HD HD NI NG NG NN HD NN NN NI<br>NN NI NG HD NG NN NI HD NG HD NI NN NI NI NN | CTCCTCCATTGCGGACATGGACTTCTCAGCCCTTCTGA GTCAGATC SEQ ID NO: 346 |

Example 50: Kiss Gene Conservation

Referring to FIG. 56, the structural organization of the kiss gene is conserved and contains two coding exons, one encoding both the signal peptide and part of the kiss peptin precursor, the other encoding the remainder of the precursor including the kisspeptin-10 sequence. The position of the intron on tilapia Kiss mRNA (corresponding cDNA, SEQ ID NO: 376) is indicated by a triangle glyph. The location of the forward and reverse primers for PCR amplification of the target region (442 bp) and the binding sites for the two engineered pairs of TALENs, Kiss1.1a (SEQ ID NOS: 456, 457) and Kiss1.1b (SEQ ID NOS:458, 459) are indicated in black and gray boxes. Panel b shows a schematic representation of the targeted kiss genomic region showing the location of the kisspeptin-10 biologically active peptide and each kiss1.1a and 1b TALENs recognition sites. PCR (442 bp) and qPCR primer pairs (138 bp amplicon) for analysis of indels are shown as well.

Example 51: Kiss and KissR Knockout in Fish

A. Construction of TALEN Expression Vectors

TABLE SHOWING CONSTRUCTION

| | Sense Left TALEN - Sense Spacer - Antisense Right TALEN |
|---|---|
| Kiss1.1a | ACAACCCTCTCAGCCTT CGCTTTGGGAAACGCT ACAATGGCTACATTTAC (SEQ ID NO: 161) |
| Kiss1.1b | CGCTTTGGGAAACGCTACAAT GGCTACATTTACAGA AGAGCTGTTAAAAGAGCC (SEQ ID NO: 162) |
| KissR E2 | CCCCTTCACCGCCACCCTTT ACCCCCTCCCTGGATGG ATCTTTGGCAACTTCATGTGC (SEQ ID NO:163) |
| KissR E3 | CTACCCCCTGAAATCTCTT CGGCACCGAACCCCCA AAGTAGCCATGATTGTCAGC (SEQ ID NO: 164) |

TABLE OF PRIMERS USED

| Target site | Primer Name | Primer sequence (5'-3') | Experiment | | |
|---|---|---|---|---|---|
| KissRE2 | QPCRE2 F | GCCACTGACATCATCTTCTTG | qPCR (112 bp) | SEQ ID NO: 165 | |
| | QPCRE2 R2 | GAAACAGAAAGTTGAAGTGG | | SEQ ID NO: 166 | |
| KissRE3 | QPCRE3 F | TCACCCTGACTGCTATGAGTGGA | qPCR (143 bp) sequencing | SEQ ID NO: 167 | |
| | QPCRE3 R2 | ATGAGTCAGTCGATAATGACACG | | SEQ ID NO: 168 | |
| KissRE2 | GKRE2F | TTATGCAAAAGAAGAAAGGTG | PCR (622 bp) | SEQ ID NO: 169 | |
| | GKRE2R | GCAGAGTTCGACCTACTTTCATTG | | SEQ ID NO: 170 | |
| KissRE3 | GKRE3F | TATACATAGCCCCCATTTTC AGTG | PCR (702 bp) | SEQ ID NO: 171 | |
| | GKRE3R | GGCAGCAGGTAGGCAGCAA | | SEQ ID NO: 172 | |
| Kiss1.1a and b | KissF | GTCCTCTGCATTCAGGAGA ACAG | PCR (442 bp) | SEQ ID NO: 173 | |
| | KissR | CTAAAAGTATTTTATTTACATAGT | | SEQ ID NO: 174 | |
| Kiss1.1a | QPCRkissF | AGGCAGCTCCTTTGCAATGAT | qPCR (138 bp) sequencing | SEQ ID NO: 175 | |
| | QPCRkissR | AGAGAAGGGTGAAAACTTTTT | | SEQ ID NO: 176 | |

B. Talen mRNA Synthesis.

MINIPREP DNA of pT3 Ts-TALEN were digested with 5-10× Units of SacI-high fidelity for 2 hours in a 200-μL, reaction. Restriction digest was treated with 8-μL RNAsecure (Ambion) and incubate at 60° C. for ten minutes. RNAsecure treated DNA was purified using the MINIELUTE PCR cleanup kit from Qiagen and eluted in 10-μL of RNAase free injection buffer (5 mM Tris Cl, pH 7.5; 0.1 mM EDTA). Synthetic mRNA were produced using the mMESSAGE MACHINE T3 kit (Ambion) using 1 ug of linearized template and 1.5 hours incubate at 37° C. After 15 minutes treatment with Turbo DNAase the mRNA was purified using the Ambion MEGACLEAR kit and eluted 2× with 50-μL of heated H$_2$O.

C. Microinjection of TALENs Pairs

RNA encoding each TALEN arm were combined and resuspended in nuclease free water at a concentration of 10-200 ng/μL. 5-20-pL were injected into one cell stage tilapia embryos. Injected embryos survival was measured at 6 days post fertilization against a non injected control group. RNA concentration giving a 50% rate of survival was used for repeat/standard injections to generate Knock outs. To confirm that injected embryos died from TALENs induced mutagenesis, deformed embryos were collected and mutation at the target site was investigated using a QPCR melt profile analysis.

D. Tissue Collection and DNA Extraction of Control and RNA Treated Tilapia.

Six day old RNA treated embryos (deformed) were dechorionated anesthetized and the yolk sac was removed using a razor blade. Embryonic tissue was digestion overnight in lysis buffer; 10 mM Tris, 10 mM EDTA, 200 mM NaCl, 0.5% SDS, 100 mg/ml proteinase K and extracted with automated Research X-tractor, Corbett robotic system using Whatman™ unifilter 800, 96 well plates (GE Healthcare, UK). Embryos that survived microinjection and developed normally (from groups with ~50% survival rate) were raised to 1 month of age, anaesthetized; fin clipped and place in individual jars while their fin DNA was analyzed (overnight digestion in lysis buffer followed by DNA extraction as described above). Sperm was stripped from G0 males carrying somatic mutations at the kiss or kissR loci and gDNA extracted using DNAzol Reagent (Life Technolgies) following standard procedure. Extracted DNA was resuspended in 30 μl of MQ H2O.

E. Identification of Mutation by QPCR

Real-time qPCR was performed ROTOR-GENE RG-3000 REAL TIME PCR SYSTEM (Corbett Research). 6-μL genomic DNA (gDNA) template (diluted at 1 ng/μl) was used in a total volume of 15 μL containing 0.4 μM concentrations each of the forward and reverse primers and 7.5 μL of 2× Brilliant II SYBR GREEN QPCR MASTER MIX (Agilent Technologies). qPCR primers were designed using DNAstar software (See above: Table of Primers Used). The qPCR was performed using 40 cycles of 15 seconds at 95° C., 60 seconds at 60° C., followed by melting curve analysis to confirm the specificity of the assay (67° C. to 97° C.). In this approach, to detect the occurrence of a DNA polymorphism at the targeted kiss and kissR loci, short PCR amplicons (approx 100-140 bp) that include the region of interest are generated from a gDNA sample, subjected to temperature-dependent dissociation (melting curve). When TALEN-induced polymorphisms are present in the template gDNA, heteroduplex as well as different homoduplex molecules will be formed. The presence of multiple forms of duplex molecules is detected by Melt profile, showing whether duplex melting acts as a single species or more than one species. Generally, the symmetry of the melting curve and melting temperature infers on the homogeneity of the dsDNA sequence and its length. For example, if small insertion or deletions resulting from repair of TALENs-induced DSBs by NHEJ are generated then that melting temperature will positively correlate to the length of the deletion or insertion, proportionally to the energy required to break the base-base hydrogen bonding. If multiple forms of duplex molecules are present, the temperature dependant denaturation will detect together the most instable heteroduplex and the most stable homoduplex giving a modified (dissymmetric) melt profile. The Melt analysis is performed by comparison with reference DNA sample (from non-injected tilapia control or plasmid containing the genomic region of interest) amplified in parallel with the same master mix reaction. In short, variation in melt profile distinguishes sequences carrying TALEN induced mutation from wild type sequence, thus facilitating the screen.

F. Calculating Mutation Rates in Somatic Cells or Germ Cells of Microinjected Tilapia and Characterization of TALEN Induced Mutations.

Fish whose somatic or germ cells gDNA produced asymmetric qPCR melt profiles (candidate mutant) were further analyzed to measure the mutagenic frequency. Genomic PCR products containing the target site (442 bp for Kiss and 720 bp for KissR) were obtained from fin-DNA or sperm-DNA. The PCRs were carried out in a 25-µL reaction mixture, which contained 120-180 ng template gDNA, 0.1 µl of Platinum Taq DNA polymerase, 0.2 mM dNTPs, 1× Taq DNA polymerase buffer, 2 mM Mg2+, and 0.2 µM of each primer. DNA amplification was done under the following conditions: 95° C. for 5 min, followed by 35 cycles of 94° C. for 30 s, 55° C. for 30 s, and 72° C. for 45s, with a final extension at 72° C. for 2 min. The PCR products were cloned into TOPO 2.1 TA vector (Invitrogen), and transformed into competent *E. coli* cells (ONE SHOT, Top 10F', Invitrogen). Transformant colonies were randomly picked with a sterile pipette tips and transferred directly onto individual qPCR reaction tubes before replating on selective agar media. qPCR were performed using primers that span the TALENs target sites of interest (100-140 bp amplicons). QPCR reactions showing specific product amplification were compared against a reference DNA sample control (wild type sequence) to identify melt profile variants (FIG. 10 panels c and d). DNA mutation rate was calculated as the number of mutant sequences (colonies with variant melt) divided by the total number of sequences analyzed multiplied by 100. To visualize the mutations present at the target loci, clones representing individual somatic or sperm cells were displayed in a Scatter plot of Ct versus Melt temperatures (see FIG. 10 panel d for example). In these graphs, each *E. Coli* colony is represented by a data point (x, y), with x representing its Ct and y representing its melt. Individual colonies carrying identical sequences should display similar melting temperature. Colonies showing variant melting temperature were grown overnight and their plasmid extracted and purified (MINIPREPARATION kit, QIAGEN). The region containing the TALENs target site were then sequenced using selected primers for the kiss and kissR regions, as indicated. To characterize mutations in F1 and F2 fish, the 442 bp and 702 bp amplicons containing the target kiss1.1a and KissRE3 loci were purified on silica-membrane-based spin column (QIAQUICK PCR PURIFICATION KIT, QIAGEN). The purified PCR were directly sequenced using an internal primer (KissRF).

G. Founder Screen

Gametes were stripped from all putative founders and F1 embryos were produced from in vitro fertilization with gametes collected from WT stock. 3 weeks post-fertilization, F1 progeny were fin-clipped and held separately in individual jar. Fin DNA was extracted as previously described (see Tissue collection and DNA extraction section above) and adjusted to 1 ng/µl using a spectrophotometer NANODROP ND1000). In general, 10-20 juveniles from each potential founder were screened by QPCR using the melt analysis strategy described above. For sequence confirmation, genomic DNAs from single embryo/juvenile were amplified and the PCR product submitted to sequencing after purification.

Sequencing chromatography of PCR showing two simultaneous reads are indicative of the presence of indels. The start of the deletion or insertion typically begins when the sequence read become divergent. The dual sequences are than carefully analyze to detect unique nucleotide reads (see FIG. 12 panel a). The pattern of unique nucleotide read is then analyzed against series of artificial single read patterns generated from shifting the wild type sequence over itself incrementally.

H. Mutagenic Potency of Engineered TALENs

Engineered TALENs and synthetic capped mRNA encoding each heterodimeric TALENs together was injected at various concentrations from 10 to 250 ng/µl into 1-cell stage tilapia embryos. We then observed the injected embryos at 6 days post fertilization (dpf). Embryos injected with less than 10 ng of TALENs developed normally while a dose of 200 ng (Kiss1a) and 10 ng (KissRE3) generated up to 50% of dead or deformed embryos. Dose of 250 ng for kiss1.1b and kissRE2 generated less the 30% mortality. On day five, injected embryos were separated between those that developed normally from those with morphological deformities. To check for evidence of mutations, genomic DNA was isolated from a pool of 3 deformed embryos for each TALENs treated group and from 3 normal embryos from a non injected control group. Genomic DNA was used for QPCR melt analysis of the target loci. Asymmetric melt profile were found in the pool of embryos treated with TALENs targeting the kiss1.1a and kissRE3 loci (data not shown) but not in embryos treated with the other 2 TALENs pairs.

To confirm the presence of mutation, 20-40 normally developed juveniles in each group were assayed by QPCR melt analysis. None of the fish injected with TALEN KissR-E2 and Kiss1.1b mRNA produced variant melt suggesting that either no mutation were created or that the mutation did not produce detectable melt variation. Nevertheless, a total of 8 fish producing variant melt profiles were found, 4 for each kiss1.1a and KissRE3 loci (FIG. 10 panel a and panel b). To confirm that the observed melt variation results from a mixture of wild-type and NHEJ products with microinsertion or deletion at the target site, each target region (442 bp for Kiss and 702 bp for KissR) was amplified in a PCR reaction. The resulting PCR fragments were cloned into Topo TA vectors and transformant colonies screened by direct real time-PCR. For each fish tested, between 14 and 21 *E. Coli* transformant colonies were hand-picked (randomly) and added directly (without DNA purification) to the Q-PCR reaction mixture.

Colonies carrying mutated alleles were identified by comparison to the wild-type unmodified sequence. High frequencies of colonies with variant melt profiles ranging from 50-91% were detected (FIG. 10, panels c and d).

To characterize some of these lesions, the plasmid from clones that produced variant amplicons was extracted and the PCR insert was sequenced. Between 4 and 7 clones were sequenced for each TALENs treated group and all but one carried mutated alleles. A total of fourteen different somatic mutations in the kiss and kissr genes were detected from all 8 TALENs treated fish (eight at the Kiss1.1a loci and six at KissRE3 loci). Nine different nucleotide deletions, two insertions, and three combinations of nucleotide insertions and deletions were observed (FIG. 11 panels a and b). A deletion/insertion of as little as 3 bp was detectable by RT-PCR melt analysis. It was observed that TALENs induced mutation occurs multiple times in an RNA treated fish resulting in mosaic somatic mutations (see table below).

It was found that more than 95% of the sequences from colonies showing melt variation carry a mutation indicating that DNA mutation rate can be approximated by measuring the frequency of clones producing variant melt. Thus, the rate of mutation was calculated to be between 35% and 91% depending on the fish. This result indicates the highly efficient introduction of targeted indels at the expected genomic locations.

The table, Summary of the results of somatic mutation screen, shows results for TALENs-injected tilapia. The second column describes the mutant sequences identified in somatic cells, including the sizes of the indels (+, insertion; −, deletion) and the resulting protein sequence modification are shown inside the parentheses. In the last column, the estimated rate of somatic mutation for each fish was calculated from the frequency of colonies producing variant melting temperature.

TABLE

Summary of the results of somatic mutation screen

| Fish reference | Mutation type | % of mosaic somatic mutations (n = total number of colonies screened) |
|---|---|---|
| Kiss17 | +10 nt(frame shift/stop); +4 nt (frame shift/stop); Δ12 nt (−4AA) and Δ18 nt (−6AA) | 73% (n = 22) |
| Kiss19 | Δ12 nt (−4AA) | 48% (n = 21) |
| Kiss20 | Δ16 nt (frame shift/stop); Δ12 nt (−4AA) | 91% (n = 23) |
| Kiss41 | Δ4 nt (frame shift/stop); Δ12 nt (−4AA and F > C); Δ12 nt (−4AA) | 85% (n = 14) |
| RE3-1 | Δ10 nt (frame shift/stop); Δ7 nt (frame shift/stop) | 35% (n = 21) |
| RE3-4 | Δ3 nt (frame shift/stop); Δ26 nt (frame shift/stop) | 85% (n = 14) |
| RE3-6 | Δ5 nt (frame shift/stop); Δ14 nt (frame shift/stop) | 63% (n = 16) |
| RE3-11 | Δ7 nt (frame shift/stop) | 66% (n = 21) |

I. Sequence Analysis of TALENs Mutations

Of the different types of nucleotide mutation, five and six caused a frameshift leading to the generation of premature stop codons in the kiss and kissr gene respectively. Also, there was a high frequency of 12 nt deletions at the Kiss1.1a loci which occurred independently in all 4 TALENs treated fish. This mutation result in the loss of 4 amino acids (AA).

F0 TALENs-mutated tilapia were raised to sexual maturity and their sexes were determined. To show thatr TALENs treated fish can induce heritable mutations; genomic DNA was extracted from the semen's of each spermiating animals and screened. The frequency of sperm carrying mutation was determined by the frequency of clones showing variant melt profiles as previously described. To characterize the sperm associated lesions, the plasmids from colonies with variant melt was extracted and sequenced. Germline mutation frequency ranging from 50% to 91% was observed. Sequences revealed the existence of multiple indels in each fish germline.

TABLE

| | Sequencing | |
|---|---|---|
| Male Fish reference | Mutation type | % of mosaic somatic mutations (n = total number of colonies screened) |
| Kiss17 | Δ12 nt (−4AA) and Δ18 nt (−6AA) | 50% (n = 20) |
| Kiss19 | Δ12 nt (−4AA); +3 nt (+1AA) | 65% (n = 30) |
| Kiss20 | Δ16 nt (frame shift/stop); Δ12 nt (−4AA) | 91% (n = 23) |
| RE3-4 | Not sequenced | 88% (n = 18) |
| RE3-6 | Not sequenced | |

J. Analysis of Germ Line Mutations at the Kiss and kissR Loci.

To further demonstrate that Kiss and kissR TALENs effectively induced mutation in the germ line, the 8 founders were intercrossed with wild-type stocks. All 8 TALENs treated fish were fertile and produced viable clutches of embryos. These progeny were raised and screened for the presence of mutated alleles. All 8 founders could transmit heritable mutations. The analysis first showed that the fraction of progeny carrying putative mutation ranged between 16% and 90% as gauged by QPCR melt profile analysis of F1 fin-DNA extracts. As expected, there was a positive correlation between the extent of mosaicism in the TALENs treated parent and the frequency of progeny carrying a mutation. Analysis of selected gene sequences producing deformed melt profile all revealed a range of induced indel mutations, some of which were previously found in somatic tissue of the founders (FIG. 12 panel b). Furthermore, sequencing of F1 fish producing wild type melt all revealed wild type sequences. More than one type of heritable mutation from a single founder was often observed, suggesting that those mutations occurred independently in different germ cells within the same animal. Inherited mutations included deletions ranging in size from 3 to 18 bp (FIG. 12 panel b). In the progeny of all 4 kiss mutant founders, the only inherited mutations were deletions of 12 nt and 18 nt which resulted in the loss of four and six AA. Although, those deletions did not result in frameshift mutations they remove either one or three AA at the most C-terminal region of the kiss-10 peptide (FIG. 12 panel c). Because this core sequence was found essential and sufficient for the activation of the kissR signaling pathway throughout vertebrates, those mutations would produce a loss of function phenotype. Also identified was a frame shift mutation at the kissRE3 loci which was not previously isolated in the founder. All frameshift mutations resulted in a premature stop codon removing between 172 AA and up to 215 AA (±7 nt, FIG. 12 panel c) from the C-terminal portion of the KissR protein. These mutations, which remove as much as 57% of the protein sequence, will inactivate the gene function. All kiss and kissr mutations identified among the juveniles F1 offspring were viable in the heterozygous state.

TABLE

Summary of founder screening results. In the last column of
each table, the numbers of embryos carrying
indel mutations are shown outside of the parentheses, and
the sizes of the indels are shown inside the parentheses.
+, insertion; −, deletion.

| Fish reference (sex) | % F1 with putative mutations (n = total number of F1 screened) | #F1 sequenced (Variant + WT melt) | # of mutants identified | Mutation type |
|---|---|---|---|---|
| Kiss17 (♂) | 66% (n = 30) | 13 + 2 | 13 | 7{Δ12 nt (−4AA)}and 6 {Δ18 nt (−6AA)} |
| Kiss19 (♂) | 49% (n = 37) | 10 + 2 | 10 | 10 {Δ12 nt (−4AA)} |
| Kiss20 (♂) | 73% (n = 29) | 12 + 2 | 12 | 12{Δ12 nt (−4AA)} |
| Kiss41 (♀) | 16% (n = 38) | 6 + 2 | 6 | 6{Δ12 nt (−4AA)} |
| RE3-1 (♀) | 29% (n = 44) | 19 + 2 | 19 | 10{Δ3 nt (−1AA, R > Q); 8 {Δ11 nt (frame shift/stop)}; 1{ Δ8 nt, (frameshift/stop)} |
| RE3-4 (♂) | 90% (n = 22) | 10 + 2 | 10 | 9{Δ9 nt (−3AA)}; 1{Δ5 nt, (frame shift/stop)} |
| RE3-6 (♂) RE3-11 (♀) | 63% (n = 35) | 11 + 2 | 11 | 10{ Δ7 nt (frame shift/stop); 1{Δ5 nt (frame shift/stop)} |

K. F1 and F2 Generations

F1 heterozygous mutants showed no morphological defect as they continued to develop, and all differentiated into fertile adult of both sex. The absence of a reproductive phenotype in sexually mature F1 generation is not unexpected given the presence of a wild type allele of each targeted gene in all somatic cells of selected mutant. The characterization of an inactivation phenotype is only possible in the F2 generation in fish carrying the associated loss-of-function mutation in the homozygous (or compound heterozygous) state. To generate homozygous mutation, sperm and eggs collected from F1 heterozygous mutant were used to produce F2 generations.

Example 52: Introgression of the Bovine Polled Allele into Horned Cells by TALEN Stimulated HR The polled allele schematic is shown in FIG. 61. Four TALEN pairs were designed to cut 3' of the region duplicated in polled (FIG. 61). The target sequences of the TALENs are shown in FIG. 61B (HP1.1 left and right (SEQ ID NOs: 240 and 347); HP1.2 left and right (SEQ ID NOS: 348 and 149); HP1.3 left and right (SEQ ID NOS: 150 and 151); HP1.4 left and right (SEQ ID NOS: 152 and 153). The TALEN sequences are provided as follows (HP1.1 left and right (SEQ ID NOs: 460 and 461); HP1.2 left and right (SEQ ID NOS: 462 and 463); HP1.3 left and right (SEQ ID NOS: 464 and 465); HP1.4 left and right (SEQ ID NOS: 466 and 467). Horned Holstein fibroblasts were transfected with mRNA encoding the TALEN pairs and analyzed for activity 3 days post transfection. Surveyor assay revealed activity of each TALEN pair (FIG. 61). Peak activity was observed with HP1.3 and thus was chosen for subsequent experiments. Horned Holstein primary fibroblasts were transfected with 2 micrograms of HP1.3 TALEN mRNA along with ssDNA repair templates at the indicated quantities and treatments (FIG. 64). One of the repair templates is shown schematically in FIG. 62a (1594 bp template, SEQ ID NO: 381) and is a contiguous sequence from Angus genomic DNA containing a duplication of 212 bp that replaces a 10 bp deletion relative to the horned allele. The 212 bp duplication is depicted by arrows in both FIGS. 61a and 62a, the deletion of 10 bp is depicted by a short arrow in FIG. 61a. The 5' homology arm can be defined as the 3' section of the 1594 bp template beginning immediately after the 212 bp duplication (a total of 555 bp). Hence 1594 subtract 827 subtract 555=212, the length of the inserted sequence/ duplication that comprises the Celtic polled allele. Being identical to the exogenous Angus allele, the TALENs can no longer effectively cleave the polled allele due to separation by about 212 bp because of the 212 duplication. Populations of cells three days post transfection were analyzed for conversion to polled by PCR. Coating of the repair template with NLS-RecA-Gal4 (Liao and Essner 2011) had a significant effect on the frequency of polled conversion (FIG. 64 panels b and c). Polled conversion was also apparent in individual colonies (FIG. 63).

Methods: Approximately 600,000 cells were transfected with the NEON transfection system under the following parameters (1 pulse; 1800 v; 20 ms width). Each transfection consisted to two micrograms of TALEN mRNA along with the indicated repair template. Repair template was coated with Gal4:RecA by the following method. Five hundred nanograms (3 ul total) of repair template PCR product was incubated for 10 min at 95° C. and placed on ice for 2 minutes prior to addition of 0.8 ul of buffer [100 mM Tris OAc, pH 7.5; 500 mM NaOAc; 10 mM DTT; 10 mM Mg(OAc)2], 0.6 ul 16.2 mM ATPγS (Sigma) and 1,250 ng of NLS-RecA-Gal4 in a total reaction volume of 8 ul. This reaction was then incubated at 37° C. for 30 minutes and placed on ice. The entire volume was used in a single transfection. Cells were cultured and analyzed using methods described in Carlson, Tan et al. 2012. The 591 bp HDR template was used.

Example 53

Cells made by, or embryos modified by, the methods described herein to introgress polled alleles are cloned and/or placed in surrogate females, gestated, and born as live animals comprising the POLLED allele. Whole live animals made from the cells of Example 22B are shown in FIG. 68. The animals shown do not have horns and are healthy animals that are Holsteins with a non-meiotically introgressed pollele allele that replaces the cognate portion of the native horned allele in Holstein cells. The conversion is confirmed by PCR as shown in FIG. 62B.

Example 54

Figure 73:
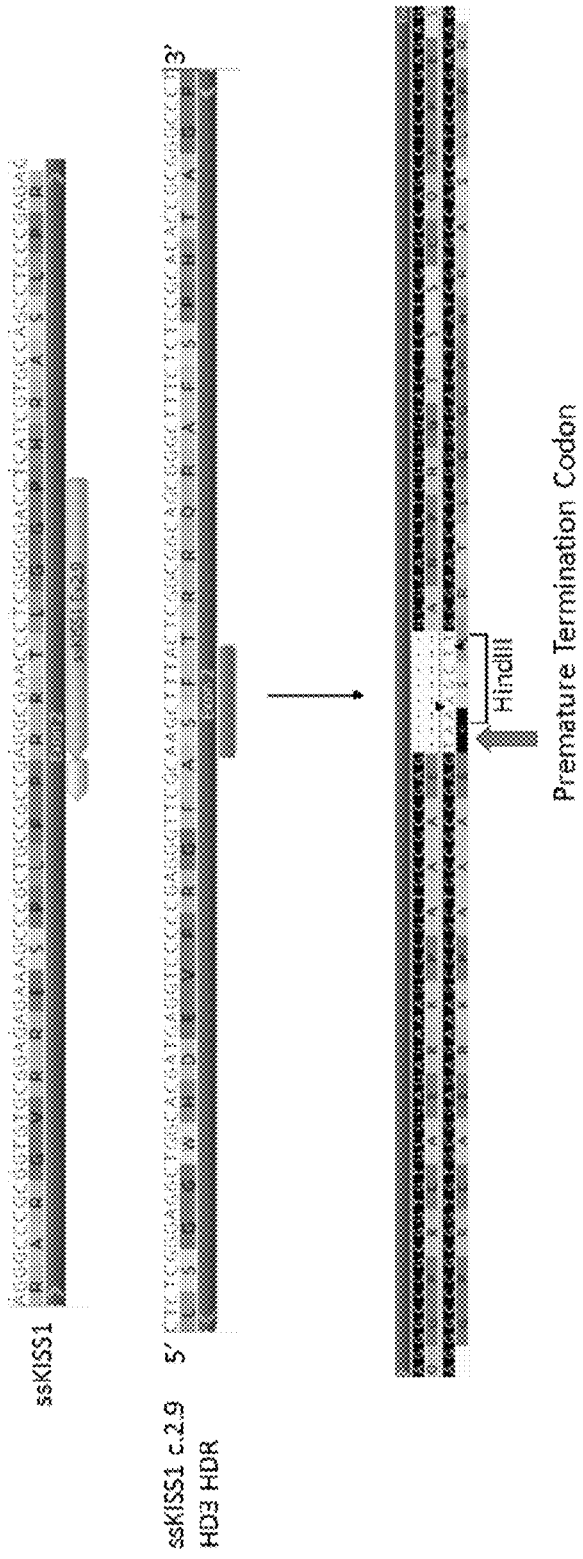
FIG. 73: CRISPR/Cas9 target sequence, ssKiss1 Exon 2 and the repair template ssKiss1 Ex2.9 for porcine fibroblast Kiss knockout experiment.

Porcine cells were modified with CRISPR/Cas9 nuclease to knockout the KISS1 gene (SEQ ID NO: 374) in porcine cells by homology dependent repair (HDR) using sgRNA ssKiss1 c.2.9 (SEQ ID NO: 391). FIG. 73 shows the CRISPR/Cas9 target sequence, ssKiss1 Exon 2 (SEQ ID NO: 389), and the repair template, ssKISS1 Ex2.9 (SEQ ID NO: 393) designed to be inserted by HDR within ssKiss1 Exon 2. The alteration effectively creates a premature termination codon followed by a HindIII restriction site for restriction fragment length polymorphism (RFLP) genotyping (SEQ ID NO: 394). As a control, a repair template containing a cut blocking mutation, ssKiss1c.2.9 Blocking HDR (SEQ ID NO: 390) was co-injected with the ssKiss1

Figure 74:
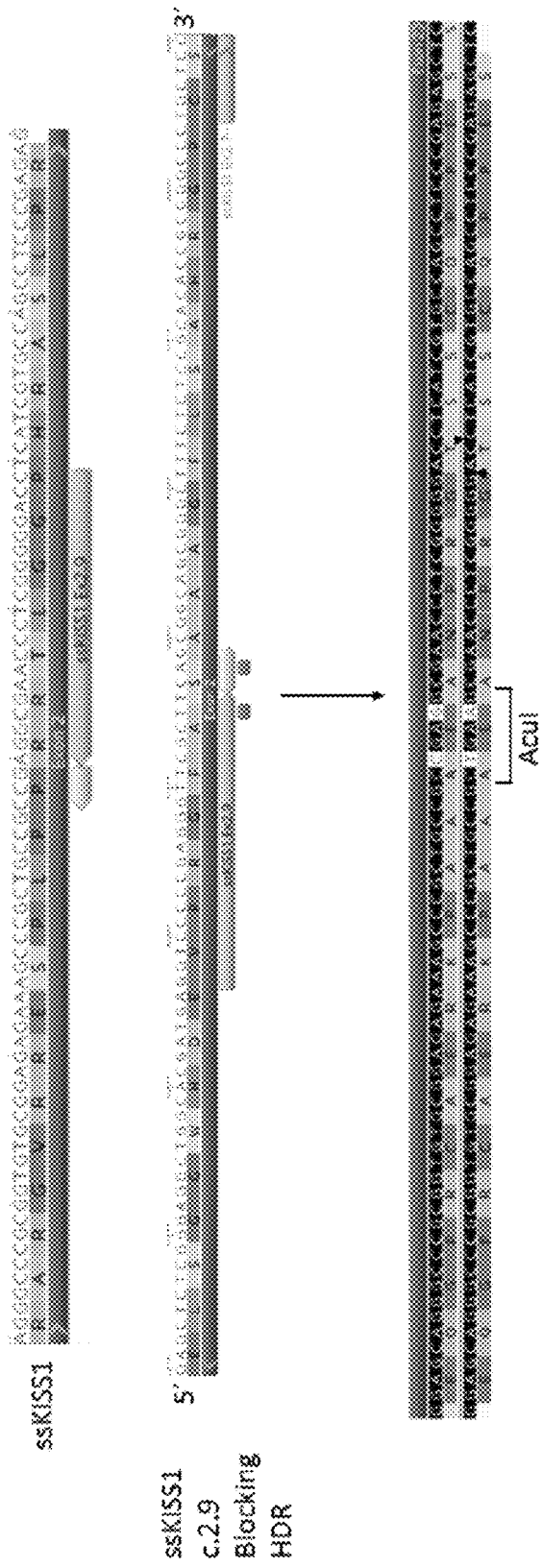
FIG. 74: CRISPR/Cas9 target sequence, ssKiss1 Exon 2, and the repair template ssKiss1c.2.9 Blocking HDR designed to be inserted by HDR within ssKiss1 Exon 2 for porcine fibroblast Kiss knockout experiment.
Figure 75:
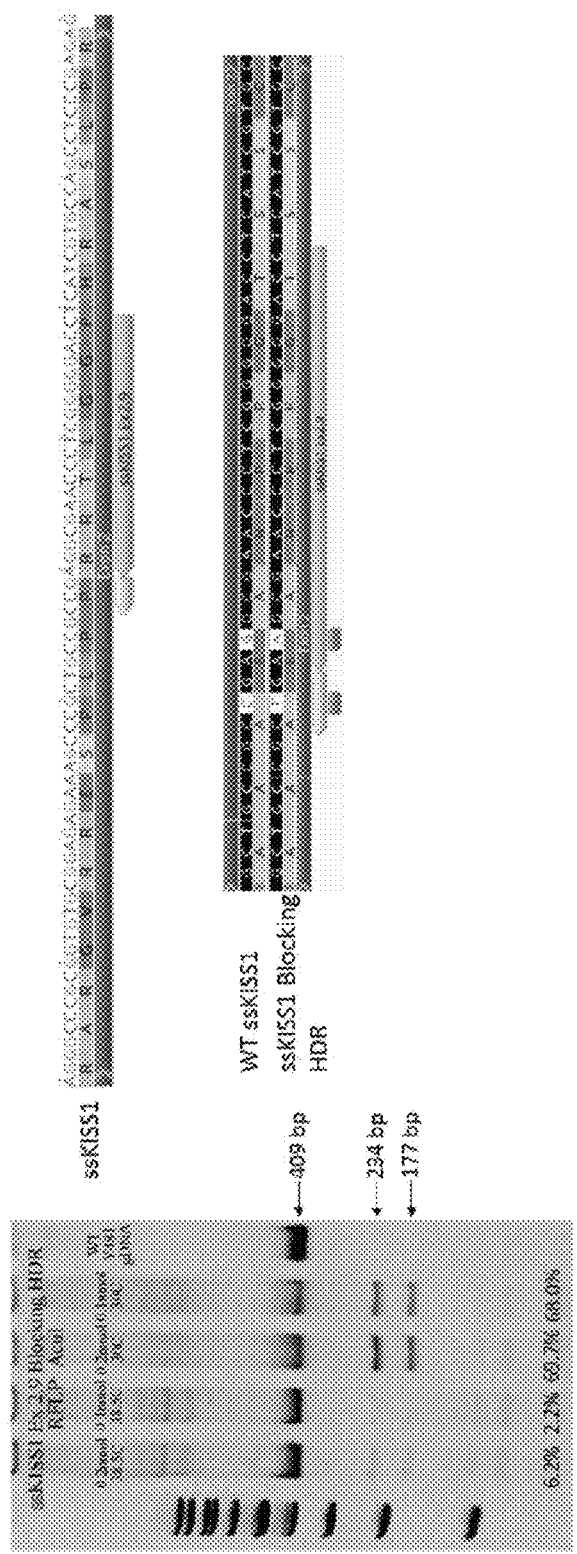
FIG. 75: Efficiency of blocking HDR oligo in fibroblast population. The blocking oligo changes the CGG PAM to CAG and introduces a silent mutation to generate an AcuI restriction site. The gel shows the results of RFLP analysis, indicating the inclusion of the AcuI restriction site.

Ex2.9 to increase the chance of heterozygous knockout offspring versus homozygous knockout offspring. FIG. 74 shows the CRISPR/Cas9 target sequence, ssKiss1 Exon 2, and the repair template ssKiss1c.2.9 Blocking HDR designed to be inserted by HDR within ssKiss1 Exon 2. FIG. 75 shows the results of RFLP analysis of porcine cells injected with the ssKiss1c.2.9 Blocking HDR oligonucleotide, generating a AcuI restriction site.

Example 55

Figure 76:
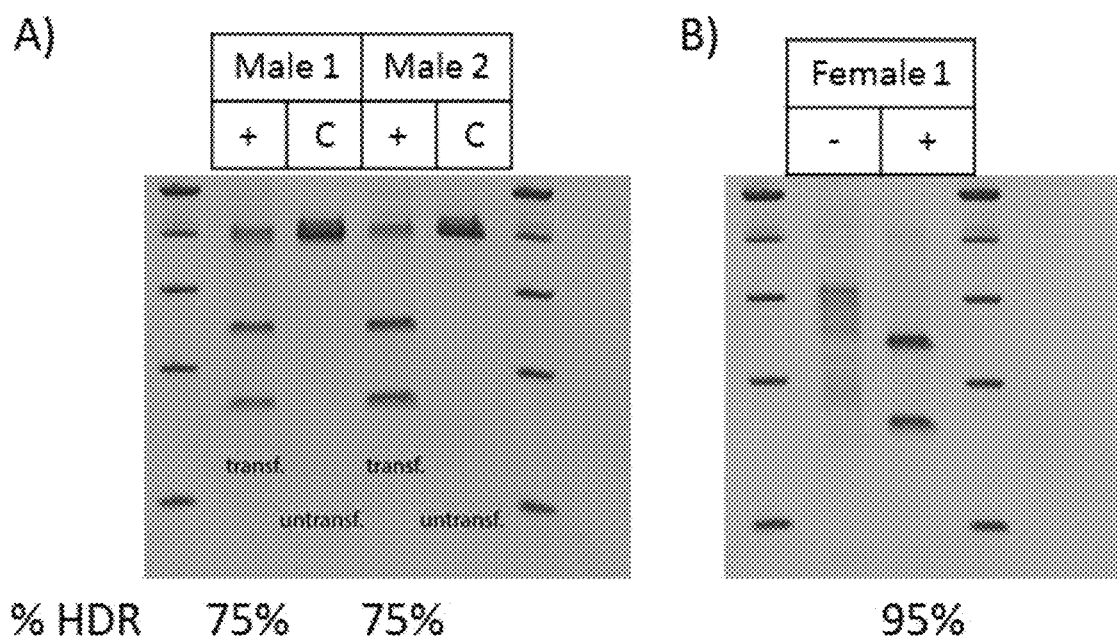
FIG. 76: Kiss swine fibroblast transfection population data without the Blocking HDR oligo. Panel A shows the RFLP analysis of male pig fibroblasts next to transfected (+) or non-transfected (C) controls. Cells were transfected with a combination of IDT Alt-R crRNA:Tracer RNA complex, Cas9=Alt-R HiFi Cas9 nuclease (protein) and ssKiss1 c.2.9 HD3 HDR. Results show RFLP analysis 3 days after transfection. Panel B shows RFLP analysis of Female pig fibroblasts transfected with IDT Alt-R crRNA:Tracer RNA complex, Cas9=Alt-R HiFi Cas9 nuclease (protein) with and without the ssKiss1 c.2.9 HD3 HDR template. Results show RFLP analysis 3 days after transfection. Cells from these populations were plated at low density for isolation of single cell derived colonies and evaluated for editing. Select homozygous HDR clones were confirmed by Sanger Sequencing and used for cloning founder animals.
Figure 78:
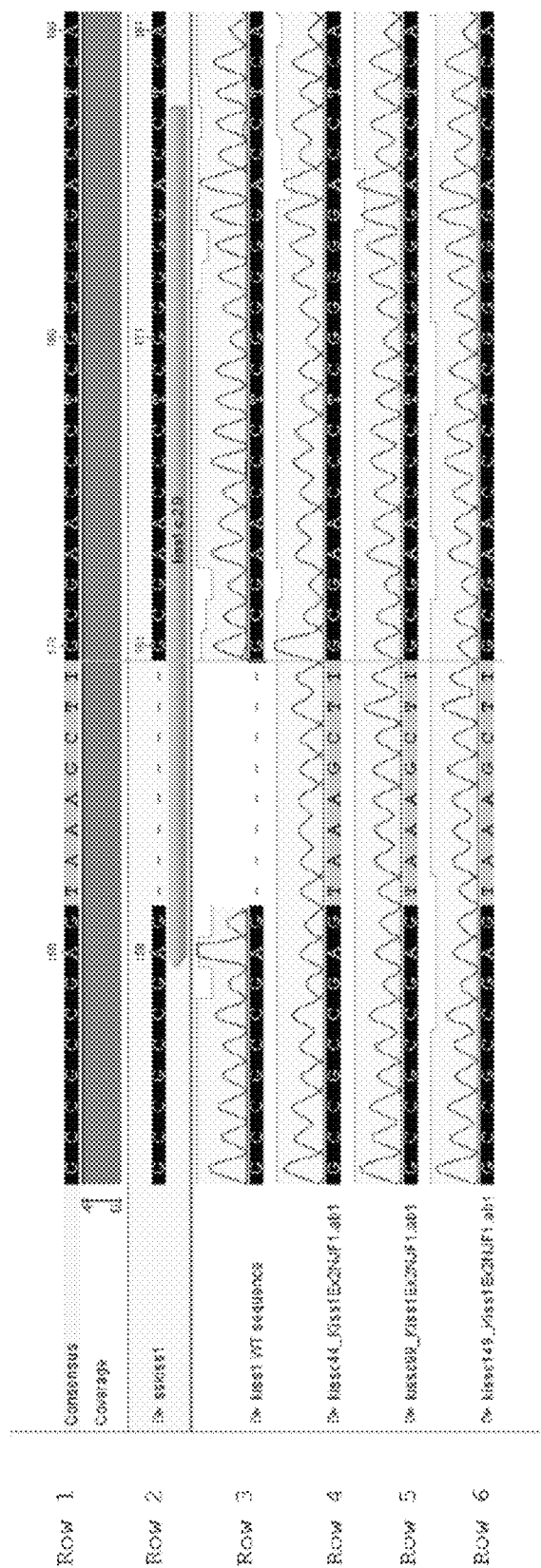
FIG. 78: Confirmation of HDR in RFLP positive colonies by Sanger Sequencing. Row 1 shows the consensus sequence from the alignment. Row 2 shows the predicted sequence from Ensembl. Row 3 shows sequence of untransfected kiss1 cells. Rows 4-6 show sequence of from colonies isolated after transfection with the gene editing reagents. These are examples of colonies with homozygous HDR with the ssKiss1 c.2.9 HD3 HDR as indicated by the 8 bp insertion. The colony represented in row 5 was used for production of founder animals by cloning.

Male pig fibroblasts were either transfected (+, transf.) or non-transfected controls (C, untransf.). Cells were transfected with a combination of IDT Alt-R crRNA:Tracer RNA complex, Cas9=Alt-R HiFi Cas9 nuclease (protein) and ssKiss1 c.2.9 HD3 HDR (SEQ ID NO: 394). FIG. 76, panel A show RFLP analysis results 3 days after transfection. Female pig fibroblasts were transfected with IDT Alt-R crRNA:Tracer RNA complex, Cas9=Alt-R HiFi Cas9 nuclease (protein) with and without the ssKiss1 c.2.9 HD3 HDR template. FIG. 76, panel B shows RFLP analysis results 3 days after transfection. Cells from these populations were plated at low density for isolation of single cell derived colonies (next slide) and evaluated for editing. Select homozygous HDR clones were confirmed by Sanger Sequencing and used for cloning founder animals. FIG. 77 shows RFLP analysis results of individual colonies propagated from the transfected populations, resulting in three outcomes: Mutant RFLP (2), Heterozygous RFLP (3), or wild type (WT) RFLP(1). FIG. 78 shows the results of Sanger Sequencing of RFLP positive colonies.

Example 56

Figure 79:
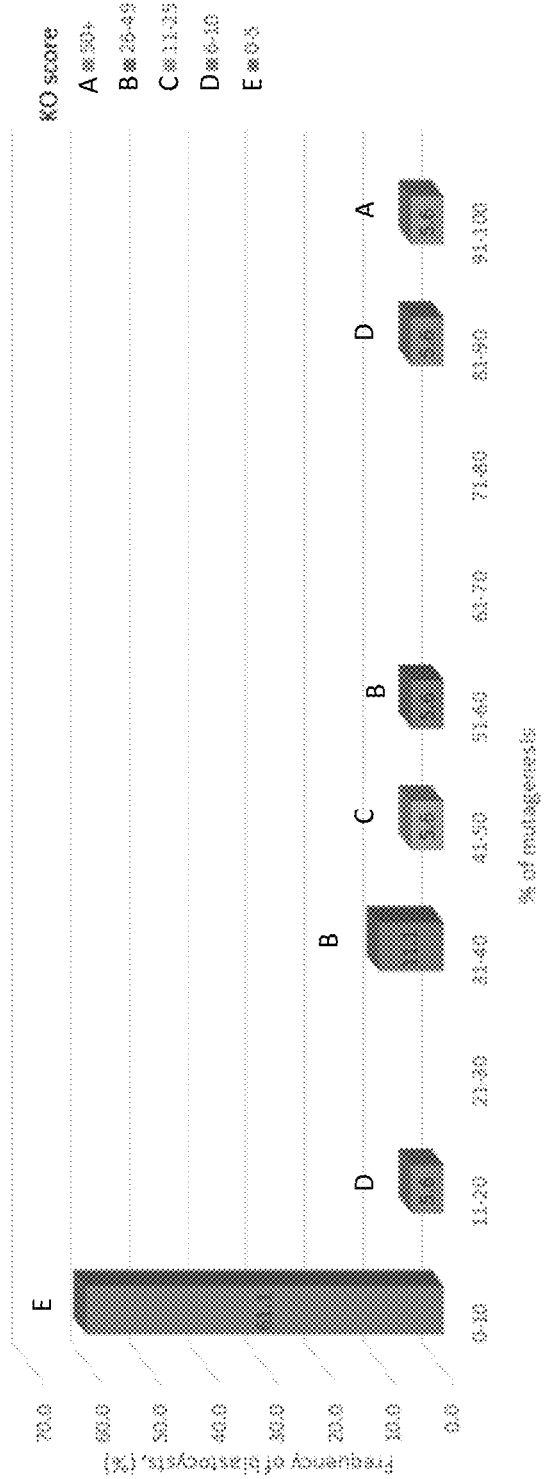
FIG. 79: Confirmation of Kiss1 knockout by HDR in pig zygotes. 25 ng/µl gRNA; 50 ng/µl Cas9; 33.3 ng/µl HD3 HDR; 66.7 ng/µl Blocking HDR Microinjection: n=18. The injected zygotes were cultured to blastocyst stage prior to whole genome amplification, PCR over the target site, and Sanger Sequencing. Amplicons were sequenced using Sanger Sequencing followed by analysis using ICE software (Synthego). Results indicate that about 22% of injected zygotes were heterozygous (31-60% mutant). Guide RNA is IDT Alt-R crRNA: Tracer RNA complex, Cas9=Alt-R HiFi Cas9 nuclease (protein). HDR templates are IDT ssDNA oligonucleotides.

Transfection of pig fibroblasts to knockout Kiss1 by HDR. The injected zygotes were injected with 25 ng/µl gRNA; 50 ng/µl Cas9; 33.3 ng/µl HD3 HDR; 66.7 ng/µl Blocking HDR. There were a total of 24 blastocysts resulting from injection. 18 of the 24 samples were subjected to whole genome amplification, PCR over the target site, and Sanger sequencing. Amplicons were sequenced using Sanger sequencing followed by analysis using ICE software, Synthego. 61% of the blastocysts were wild type (WT), 39% had a mutation within >10% of the allele. HDR was successful in one blasocyst, sequencing data show that it was repaired with the Blocking Oligo and was mono-allelic. FIG. 79 shows the results, ~22% of injected zygotes were heterozygous, meaning that they were 31-60% mutant cells.

Example 57

Figure 80:
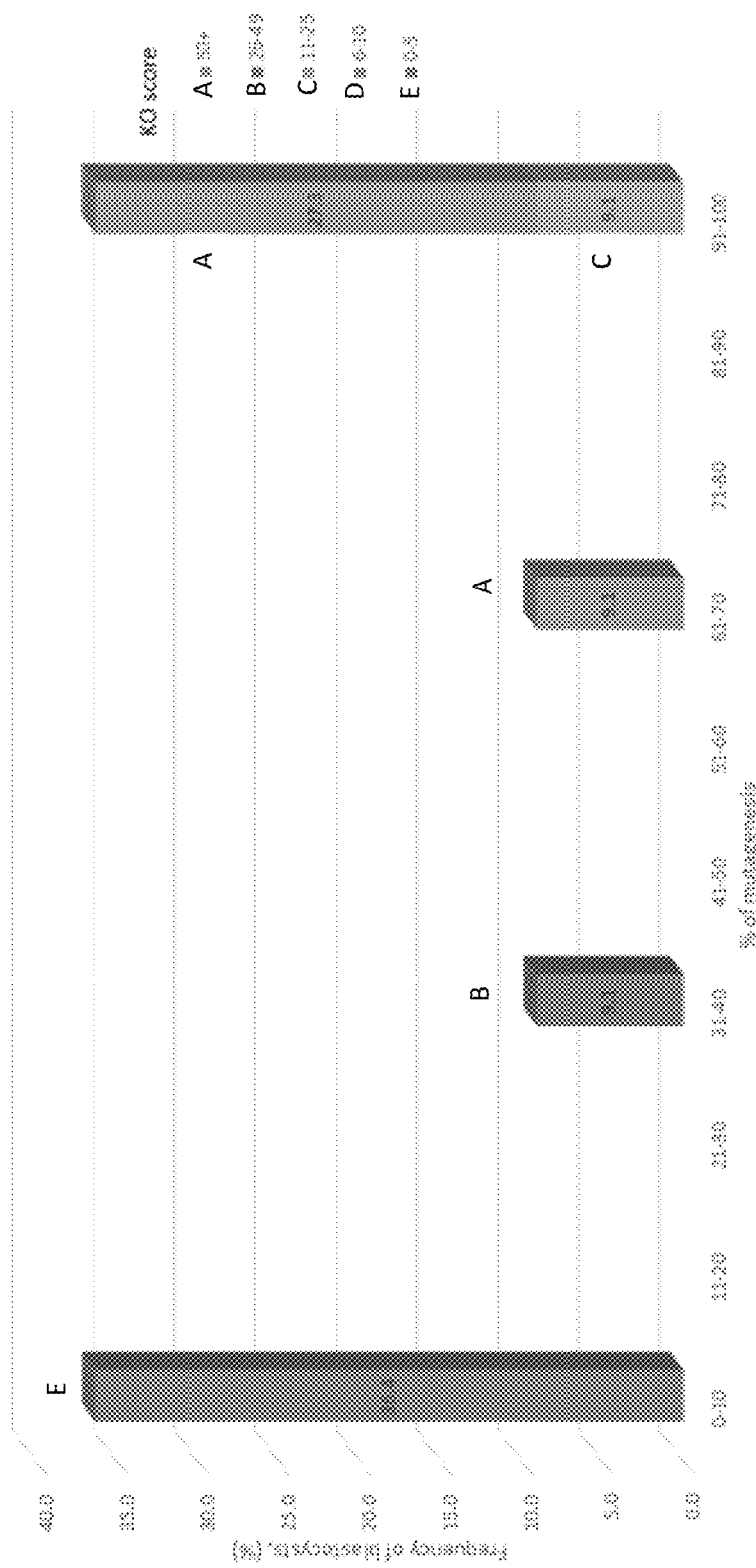
FIG. 80: Confirmation of Kiss1 knockout by HDR in pig zygotes. 25 ng/µl gRNA; 25 ng/µl Cas9; 26.7 ng/µl HD3 HDR; 53.3 ng/µl Blocking HDR Microinjection: n=11. The injected zygotes were cultured to blastocyst stage prior to whole genome amplification, PCR over the target site, and Sanger Sequencing. Amplicons were sequenced using Sanger Sequencing followed by analysis using ICE software (Synthego). Results indicate that about 9% of injected zygotes were heterozygous (31-60% mutant). Guide RNA is IDT Alt-R crRNA: Tracer RNA complex, Cas9=Alt-R HiFi Cas9 nuclease (protein). HDR templates are IDT ssDNA oligonucleotides.

Transfection of pig fibroblasts to knockout Kiss1 by HDR. Similar to Example 56, zygotes were injected with 25 ng/µl gRNA; 25 ng/µl Cas9; 26.7 ng/µl HD3 HDR; 53.3 ng/µl Blocking HDR. There were a total of 14 blastocysts resulting from injection. 11 of the 14 samples were subjected to whole genome amplification, PCR over the target site, and Sanger sequencing. 36.4% were wild type and the rest had biallelic mutation or monoallelic mutation. Five embryos had HDR events. One embryo was mono-allelic for the HD3 HDR, one embryo was mono-allelic for both HDR templates (HD3 HDR and Blocking HDR) and three embryos were positive for Blocking HDR (one of which was bi-allelic). FIG. 80 shows the results. The embryos were implanted in a sow, resulting in a brood of piglets. Nineteen piglets were born and two were born stillborn.

Example 58

Cells can made by, or embryos modified by, the methods described in Example 51 to knockout KISS 1 in *bovine* cells (SEQ ID NO: 375).

TABLE 8

Table 8: TALEN to Figure mapping.

| FIG. | Target identified | Animal | Gene | Repair type | TALENs form | Cell type | TALEN ID | HDR template | Samples (n=) |
|---|---|---|---|---|---|---|---|---|---|
| 3B | no | Bovine | ACAN | NHEJ | mRNA | Embryo | btACAN12 | — | 6 |
| 3C | no | Porcine | p65 | NHEJ | mRNA | Embryo | ssP65_11-1 | — | 14 |
| 4A | yes | Bovine | ACAN | NHEJ | mRNA | Embryo | btACAN12 | — | 4 |
| 4B | yes | Porcine | p65 | NHEJ | mRNA | Embryo | ssP65_11-1 | — | 17 |
| 5B | no | Porcine | DMD | NHEJ | Plasmid | Fibroblast | ssDMDE7.1 | — | Population |
|  | no | Bovine | ACAN | NHEJ | Plasmid | Fibroblast | btACAN12 | — | Population |
| 5C | no | Porcine | DMD | NHEJ | Plasmid | Fibroblast | ssDMDE7 | — | Population |
|  | no | Porcine | LDLR | NHEJ | Plasmid | Fibroblast | ssLDLR4.1 | — | Population |
|  | no | Bovine | PRNP | NHEJ | Plasmid | Fibroblast | btPRNP3.1 | — | Population |
|  | no | Porcine | GDF8 | NHEJ | Plasmid | Fibroblast | ssGDF83.2 | — | Population |
| 6 | yes | Bovine | ACAN | NHEJ | Plasmid | Fibroblast | btACAN12 | — | 12 |
| 7B, C | No | Bovine | GDF8 | NHEJ | Plasmid | Fibroblast | btGDF83.1 | — | Population |
|  | No | Bovine | ACAN | NHEJ | Plasmid | Fibroblast | btACAN12 | — | Population |
|  | No | Porcine | DMD | NHEJ | Plasmid | Fibroblast | ssDMDE7.1 | — | Population |
|  | No | Porcine | DMD | NHEJ | Plasmid | Fibroblast | ssDMDE6 | — | Population |
|  | No | Porcine | LDLR | NHEJ | Plasmid | Fibroblast | ssLDLR2.1 | — | Population |
| 8A | yes | Porcine | LDLR | NHEJ | Plasmid | Fibroblast | ssLDLR2.1 | — | 5 |
| 8B | yes-8A | Porcine | LDLR | NHEJ | Plasmid | Fibroblast | ssLDLR2.1 | — | 5 |
| 9A | yes | Porcine | DMD | NHEJ | Plasmid | Fibroblast | ssDMDE7.1 | — | 8 |
| 9B | yes | Porcine | LDLR | NHEJ | Plasmid | Fibroblast | ssLDLR2.1 | — | 10 |
| 10 | yes | Porcine | DMD | NHEJ/ large deletion | Plasmid | Fibroblast | ssDMDE6 | — | Population |
|  | yes | Porcine | DMD | NHEJ/ large deletion | Plasmid | Fibroblast | ssDMDE7.1 | — | Population |

TABLE 8-continued

TALEN to Figure mapping
Table 8: TALEN to Figure mapping.

| FIG. | Target identified | Animal | Gene | Repair type | TALENs form | Cell type | TALEN ID | HDR template | Samples (n=) |
|---|---|---|---|---|---|---|---|---|---|
| 11 | yes | Porcine | DMD | NHEJ/ large deletion | Plasmid | Fibroblast | ssDMDE6 | — | 14 |
|  | yes | Porcine | DMD | NHEJ/ large deletion | Plasmid | Fibroblast | ssDMDE7.1 | — | Same As Above |
| 12 | yes | Porcine | DMD | NHEJ/ inversion | Plasmid | Fibroblast | ssDMDE6 | — | 8 |
|  | yes | Porcine | DMD | NHEJ/ inversion | Plasmid | Fibroblast | ssDMDE7.1 | — | Same As Above |
| 13 | yes | Bovine | GDF8 | HDR | Plasmid | Fibroblast | btGDF83.1 | dsDNA-1623 bp (BB-HDR) | Population |
| 14 | yes FIG. 13 | Bovine | GDF8 | HDR | Plasmid | Fibroblast | btGDF83.1 | dsDNA-1623 bp (BB-HDR) | 4 |
| 15 | yes | Porcine | LDLR | HDR | Plasmid | Fibroblast | ssLDLR4.2 | dsDNA, LdlrE4N-stop | Population |
| 16 | Yes. FIG. 15 | Porcine | LDLR | HDR | Plasmid | Fibroblast | ssLDLR4.2 | dsDNA, LdlrE4N-stop | 8 |
| 18 | Yes | Bovine | GDF8 | HDR | Plasmid | Fibroblasts | btGDF83.1 | AAV-1623 bp (BB-HDR) | Population |
| 19 | Yes | Bovine | GDF8 | HDR | Plasmid | Fibroblasts | btGDF83.1 | Oligos; BB-HDR sense, BB-HDR antisense | Population |
| 20A | Yes-4B | Porcine | p65 | NHEJ | mRNA or Modified mRNA | Fibroblasts | ssP65_11-1 | — | Population |
| 20B | Yes-9A | Porcine | DMD | NHEJ | mRNA or Modified mRNA | Fibroblast | ssDMDE7.1 | — | Population |
| 21 | Yes-13 | Bovine | GDF8 | HDR | Plasmid or mRNA | Fibroblasts | btGDF83.1 | Oligos; BB-HDR sense | Population and colonies 72 |
| 22 | Yes | Bovine | GDF8 | HDR | mRNA | Fibroblasts | btGDF83.6 | Oligos; seq ID 135 | Population |
| 23 | Yes | Bovine | GDF8 | HDR | mRNA | Fibroblasts | btGDF83.6 | Oligos; seq ID 135 | Population |
| 24 | No | Porcine | GDF8 | HDR | mRNA | Fibroblasts | ssGDF83.6 | Oligos; Seq ID 146 | Population |
| 25 | Yes | Porcine | LDLR | NHEJ | mRNA | Fibroblast | ssLDLR2.1 | Oligos; Seq ID 137 | Population and colonies 184 |
| 26 | Yes-9A | Porcine | DMD | NHEJ | Plasmid or mRNA | Germline stem cells | ssDMDE7.1 | — | Population |
| 27A | Yes | Chicken | DDX4 VASA | NHEJ | Plasmid | DF1 cells | ggVASA1.1 | — | Population |
|  | Yes | Chicken | DDX4 VASA | NHEJ | Plasmid | DF1 cells | ggVASA7.1 | — | Population |
| 27C | Yes | Chicken | DDX4 VASA | HDR | Plasmid | Primordial germ cells | ggVASA1.1 | dsDNA-Donor targeting vector | Population |

"Population" = to targeted modification of 1,000-20,000 cells in the experimental group

TABLE 9

TALEN to Table mapping
Table 9: TALEN to Table mapping.

| Target Table | identified | Animal | Gene | Repair type | TALENs form | Cell type | TALEN ID | HDR template | Samples (n=) |
|---|---|---|---|---|---|---|---|---|---|
| 1 | Yes-FIG. 8A | Porcine | LDLR | NHEJ | Plasmid | Fibroblast | ssLDLR2.1 | — | 275 |
|   | Yes-FIG. 15 | Porcine | LDLR | NHEJ | Plasmid | Fibroblast | ssLDLR4.2 | — | 95 |
|   | Yes-FIG. 10 | Porcine | DMD | NHEJ | Plasmid | Fibroblast | ssDMDE6 | — | 35 |
|   | Yes-FIG. 9A | Porcine | DMD | NHEJ | Plasmid | Fibroblast | ssDMDE7.1 | — | 70 |
|   | no | Porcine | GHRHR | NHEJ | Plasmid | Fibroblast | ssGHRHR2.3 | — | 43 |
|   | Yes-FIG. 6 | Bovine | ACAN | NHEJ | Plasmid | Fibroblast | btACAN12 | — | 35 |
|   | Yes-FIG. 13 | Bovine | GDF8 | NHEJ | Plasmid | Fibroblast | btGDF83.1 | — | 29 |
| 2 | no | Bovine | ACAN | NHEJ | mRNA | Embryo | btACAN11 | — | 154 |
|   | Yes-FIG. 6 | Bovine | ACAN | NHEJ | mRNA | Embryo | btACAN12 | — | 227 |
|   | no | Bovine | PRNP | NHEJ | mRNA | Embryo | btPRNP3.2 | — | 115 |
|   | Yes-FIG. 13 | Bovine | GDF8 | NHEJ | mRNA | Embryo | btGDF83.1 | — | 115 |
| 3 | Yes-FIG. 13 | Bovine | GDF8 | NHEJ | mRNA | Embryo | btGDF83.1 | — | 2 embryos |
| 4 | yes | Porcine | LDLR | NHEJ | Plasmid | Pig tail biopsy | ssLDLR2.1 | — | 22 |
| 5 | Rows 1-12 same as Table 1. |  |  |  |  |  |  | — |  |
|   | no | Porcine | GHRHR | NHEJ | mRNA | Fibroblast | ssGHRHR2.3 | — | 38 |
|   | Yes-FIG. 8A | Porcine | LDLR | NHEJ | mRNA | Fibroblast | ssLDLR2.1 | — | 166 |
|   | Yes-FIG. 13 | Bovine | GDF8 | NHEJ | mRNA | Fibroblast | btGDF83.1 | — | 86 |

TABLE 10

TALEN RVD Codes
Table 10: TALEN RVD codes

| TALEN ID | TALEN RVD 5' (Left) | TALEN RVD 3' (Right) | Target Sequence |
|---|---|---|---|
| btACAN12 | HD HD NG NG NG HD HD NG HD HD NI NN NN NN NI NG HD HD HD NG | NN HD NG HD HD NG HD NG NN NG NG NN HD NG NG HD NG HD HD NI NN NG | SEQ ID NO: 1 |
| btGDF83.1 | NN NG NN NI NG NN NI NI HD NI HD NG HD HD NI HD NI NN NI NI NG HD NG | NG HD NI NI NI NI NG HD HD NI HD NI NN NG NG NI NN NI NN | SEQ ID NO: 116 |
| btGDF83.2 | NN NG NN NI NG NN NI NI HD NI HD NG HD HD NI HD NI NN NI NI NG HD NG | NG HD NI NI NI NI NG HD HD NI HD NI NN NG NG NI NN NI NN | |
| btPRNP3.1 | NN HD NI NI NN NI NI NN HD NN NI HD HD NI NI NI NI HD HD NG | NI NG HD NN NN HD NG HD HD HD HD HD NI NN NG | |
| ssDMDE6 | HD NG NI NG NI HD HD NG NI NN NN NG HD NI NI NI NI NI NG | NI NN NG NG NG NI NG NG NN HD NI NG HD HD NI NN HD HD NI NG | SEQ ID NO: 91 |
| ssDMDE7 | HD NN HD NG NI NI NN NG NI NG HD NI NN NG NG NI NN NN HD NI NG | HD HD HD NI NI NI NI NG NN HD NI HD NG NI NI HD HD NG | |
| SSDMDE7.1 | NN NN NI NI HD NI NG NN HD NI NG NG HD NI NI HD NI NG | HD HD NI NN NG NI NN NG NG NG HD NG HD NG NI NN NG HD HD NG | SEQ ID NO: 55 |
| ssLDLR2.1 | HD NG HD HD NG NI HD NI NI NN NG NN NN NI NG NG NG | HD NN NN NI HD HD NN NG HD NG NG NN HD NI HD NG | SEQ ID NO: 39 |
| ssLDLR4.1 | HD HD NI HD NG HD HD NI NN HD NG NN NN HD NN HD NG | HD NN NG NI NN NI HD NG NG NN NG HD HD NG NN NN HD NI NN NG | |
| ssGDF83.2 | HD NG NI NI HD NG NN NG NN NN NI NG NG NG NG NN NI NI NN HD NG | HD NG NG NG NN NN NN NG NN HD NI NG NI NI NG | |
| ssLDLR4.2 | HD HD NI NN NG NN HD NI NI HD NI NN HD NG HD NI HD HD NG | HD NI NN NG NI HD NI HD HD NI NG HD HD NI NI NN NN HD HD | |
| ssP65_11-1 | NN HD HD HD HD HD HD HD NI HD NI HD NI NN HD NG | NI NG NI NN HD HD NG HD NI NN NN NN NG NI HD NG | SEQ ID NO: 7 |

TABLE 10-continued

TALEN RVD Codes
Table 10: TALEN RVD codes

| TALEN ID | TALEN RVD 5' (Left) | TALEN RVD 3' (Right) | Target Sequence |
|---|---|---|---|
| btGDF83.6 | NN HD NG HD NG NN NN NI NN NI NI NG NN NG | NI NG NN NI NN NN NI NG NI HD NG NG NG NG | SEQ ID NO: 135 |
| ssGDF83.6 | NI HD NG NN HD NG HD NG NN NN NI NN NI NN NG | NN NG NN NI NN NN NN NG NI NG NG NG NG NG NN NG | |
| ggVASA1.1 | NN HD NG NI NI HD NN NG NN HD NG HD HD NG NN NN NG HD HD NG | HD HD NG HD HD NG HD HD NI NG NI NN HD NN NI NI NG | |
| ggVASA7.1 | NI NG NI NG HD NG NI NI NI NI HD NG NN NN NI NG | NN HD NG NN NG NN HD NG NG HD NG NN HD NI HD NG | |
| ssGHRHR2.3 | HD HD HD HD NG NN HD HD HD NN NN HD NG NG NG HD NG NG HD NG | HD HD HD HD HD NG HD NI HD HD NG NN NN HD NG | |
| btACAN11 | NN HD NI NI NG HD HD HD NI NN NN HD NG NG HD NI HD HD NN NG NG | NN NG NI NN NN HD NI NI NN NG NG HD HD HD NI NG NG HD HD NN NG | |
| btPNRP3.2 | HD NI NI NG NN NN NI NI HD NI NI NI HD HD HD NI NN NG NI NI | NN HD NI NN HD NI NN HD NG HD HD NG NN HD HD NI HD NI NG NN HD NG NG | |
| ssP65_11-1 | NN HD HD HD HD HD HD HD NI HD NI HD NI NN HD NG | NI NG NI NN HD NG HD NI NN NN NN NG NI HD NG | |
| btGDF83.6 | NN HD NG HD NG NN NN NI NN NI NI NG NI NG | NI NG NN NI NN NN NI NG NI HD NG NG NG NG | |
| ssGDF83.6 | NI HD NG NN HD NG HD NG NN NN NI NN NI NN NG | NN NG NN NI NN NN NN NG NI NG NG NG NG NG NN NG | |
| ggVASA1.1 | NN HD NG NI NI HD NN NG NN HD NG HD HD NG NN NN NG HD HD NG | HD HD NG HD HD NG HD HD NI NG NI NN HD NN NI NI NG | |
| ggVASA7.1 | NI NG NI NG HD NG NI NI NI NI HD NG NN NN NI NG | NN HD NG NN NG NN HD NG NG HD NG NN HD NI HD NG | |
| ssGHRHR2.3 | HD HD HD HD NG NN HD HD HD NN NN HD NG NG NG HD NG NG HD NG | HD HD HD HD HD NG HD NI HD HD NG NN NN HD NG ss | |
| btPNRP3.2 | HD NI NI NG NN NN NI NI HD NI NI NI HD HD HD NI NN NG NI NI | NN HD NI NN HD NI NN HD NG HD HD NG NN HD HD NI HD NI NG NN HD NG NG | |
| ssDAZL3.1 | NN NN NI NG NN NI NI NI HD HD NN NI NI NI NG NG | HD NG NG NG NG NI HD NG NN NI NI HD HD NI NG NI NG | |
| ssTp53 | NN NN HD NI HD HD HD NN NG NN NG HD HD NN HD NN HD | HD NI NG NN NG NI HD NG HD NG NN NI HD NG NG | |
| ssAPC14.2 | NN NN NI NI NN NI NI NN NG NI NG HD NI NN HD HD NI NG | NN NI HD HD HD NI NN NI NI NG NG NG HD NG NN NG | |
| ssKISSR | NN HD NG HD NG NI HD NG HD NG NI HD HD HD HD | NN HD NI HD NI NG NN NI NI NN NG HD NN HD HD HD NI | |
| ssIL2RG2.1 | HD HD HD NI NI NI NN NN NG NG HD NI NN NG NN NG NG NG | HD HD NI NI NN NG NN HD NI NI NG NG HD NI NN NG NI HD NG | |
| btGDF83.6 | NN HD NG HD NG NN NN NI NN NI NI NG NI NG | NI NG NN NI NN NN NI NG NI HD NG NG NG NG | |
| ssRAG2.1 | NI HD HD NG NG HD HD NG HD HD NG HD NG HD NN HD NG | HD NG NI NI NN HD NG NN HD NG NG NG NG NN NI NI NG | |
| btGGTA9.1 | HD NG NN HD NN NG HD HD NG NG HD NI NI NI NN NG | NN NG HD NN NG NG HD HD NI HD HD NG NG NG HD NG | |
| Kiss1.1a (Tilapia) | NI HD NI HD HD HD NG HD NG HD NI NN HD HD NG NG | NN NG NI NI NI NG NN NG NI NN HD HD NI NG NG NN NG | |

TABLE 10-continued

TALEN RVD Codes
Table 10: TALEN RVD codes

| TALEN ID | TALEN RVD 5' (Left) | TALEN RVD 3' (Right) | Target Sequence |
|---|---|---|---|
| Kis1.1b (tilapia) | HD NN HD NG NG NG NN NN NN NI NI NI HD NN HD NG NI HD NI NI NG | NN NN HD NG HD NG NG NG NI NI HD NI NN HD NG HD NG | |
| ssKISSR3.2 | NN HD NG HD NG NI HD NG HD NG NI HD HD HD HD | NN HD NI HD NI NG NN NI NI NN NG HD NN HD HD HD NI | |
| ssElF4G114.1 | HD HD NN NG HD HD NG NG NG NN HD HD NI NI HD HD NG NG | NG NN NN NN NN NN HD HD NI HD NN NN NG NG NN HD NG | |
| btHP1.1 | NN NI NN NI NG NI NN NG NG NG NG HD NG NG NN NN NG | NN NI NI NI NI NN NI NN NI NN NG NG NG NG NN NI HD NG NI NI NI | |
| btHP1.2 | NI NN NG NG NG NG HD NG NG NN NN NG NI NN NN | NN NI NI NI NI NN NI NN NI NN NG NG NG NG NN NI NG HD NG NI | |
| btHP1.3 | NG NG NG HD NG NG NN NN NG NI NN NN HD NG NN | NN NI NI NI NI NN NI NN NI NN NG NG NG NG NN NI NG | |
| btHP1.4 | NG HD NG NG NN NN NG NI NN NN HD NG NN NN NG | NN NI NI NI NI NN NI NN NI NN NG NG NG NG NN | |
| btPRLR9.1 (SLICK TRAIT) | NN NN HD HD NN NN HD NI HD HD NI HD NI NN HD HD | NG NI NI NI NN HD NI NG NN NG NG NN NN NG HD NG NN NG | |
| caCLPG1.1 | NN NI NN NI NN HD NN HD NI NN NN NI NI NG HD HD NI | NN NI HD NI NN NN NG NN NN NG HD HD HD NI NN HD HD | |
| caCLPG1.1a | Same as above | NI NI HD NI NN NN NG NN NN NG HD HD HD NI NN HD HD | |
| caCLPG1.1b | Same as above | NI NG HD NI NN NN NG NN NN NG HD HD HD NI NN HD HD | |
| caCLPG1.1c | Same as above | NI NG NI NI NN NN NG NN NN NG HD HD HD NI NN HD HD | |
| btDGAT14.2 | NN NN HD NI NN NN NG NI NI NN NN HD NN NN HD HD | NI NN HD NG HD NI HD NN NN NG NN HD NN HD NG | |
| btDGAT14.4 | HD NN HD NI NN NN NG NI NI NN NN HD NN NN HD HD | Same as above | |
| btDGAT14.5 | NN NN NI NI NN NN NG NI NI NN NN HD NN NN HD HD | Same as above | |
| btDGAT14.6 | NN NN HD NI HD NN NG NI NI NN NN HD NN NN HD HD | Same as above | |

TABLE 13

TALEN Sequences

| TALEN ID | Left SEQ ID NO: | Right SEQ ID NO: |
|---|---|---|
| ACAN11 +263 | 399 | |
| ACAN11 +231 | | 400 |
| ACAN12 +231 | 401 | 402 |
| ACAN12 + 63 | 403 | 404 |
| DMDE7 +63 | 406 | 407 |
| DMDE7.1 +231 | 408 | 409 |
| DMDE7.1 +63 | 410 | 411 |
| DMDE7 +231 | 412 | 413 |
| LDLR 4.1 +231 | 414 | 415 |
| LDLR 4.1 +63 | 416 | 417 |
| btPRNP3.1 +231 | 418 | 419 |
| btPRNP3.1 +63 | 420 | 421 |
| ssGDF83.2 +231 | 422 | 423 |
| ssGDF83.2 +63 | 424 | 425 |
| btGDF8 (also btGDF83.1) +63 | 428 | 431 |

TABLE 13-continued

TALEN Sequences

| TALEN ID | Left SEQ ID NO: | Right SEQ ID NO: |
|---|---|---|
| btGDF8 (also btGDF83.1) +231 | 520 | 521 |
| DMDE6 +231 | 434 | 437 |

TABLE 14 full plasmid sequence-pT3Ts-GoldyTALEN (+63 scaffold)

| TALEN ID | Left SEQ ID NO: | Right SEQ ID NO: |
|---|---|---|
| LDLR2.1 +63 | 438 | 439 |
| ssP65_11-1 | 440 | 441 |
| btGDF 83.6 +63 | 442 | 443 |
| ssGDF 83.6 +63 | 444 | 445 |

TABLE 14-continued full plasmid sequence-pT3Ts-GoldyTALEN (+63 scaffold)

| TALEN ID | Left SEQ ID NO: | Right SEQ ID NO: |
|---|---|---|
| ggVASA1.1 | 446 | 447 |
| ggVASA7.1 | 448 | 449 |
| btPNRP3.2 | 450 | 451 |
| ssTp53 | 452 | 453 |
| ssKISS | 454 | 455 |
| KISS1.1a (Tilapia) | 456 | 457 |
| KISS1.1 b (Tilapia) | 458 | 459 |
| btHP1.1 | 460 | 461 |
| btHP1.2 | 462 | 463 |
| btHP1.3 | 464 | 465 |
| btHP1.4 | 466 | 467 |
| btPRLR9.1 (Slick trait) | 468 | 469 |
| caCLPG1.1 | 470 | 471 |
| caCLPG1.1a | 472 | 473 |
| caCLPG1.1b | 474 | 475 |
| caCLPG1.1 c | 476 | 477 |
| ssGRHRH 2.3 +63 | 478 | 479 |
| ssDAZLe 3.1 +63 | 480 | 481 |
| ssAPC14.2 +63 | 482 | 483 |
| ssIL2RG 2.1 +63 | 484 | 485 |
| btGDF83.6 +63 | 486 | 487 |
| ssRAG2.1 +63 | 488 | 489 |
| btGGTA 9.1 +63 | 490 | 491 |
| ssKISSR3.2 +63 | 492 | 493 |
| ssEIF4GI 14.1 +63 | 494 | 495 |
| btDGAT14.2 +63 | 496 | 497 |
| btDGAT14.4 +63 | 498 | |
| btDGAT14.5 +63 | 499 | |
| btDGAT14.6 +63 | 500 | |

REFERENCES

Patent applications, patents, publications, and journal articles set forth herein are hereby incorporated herein by reference for all purposes; in case of conflict, the specification is controlling.

A. M. Geurts, et al., Knockout rats via embryo microinjection of zinc-finger nucleases, 325 Science (2009).

B. Reiss, et al., RecA protein stimulates homologous recombination in plants, 93 Proc Natl Acad Sci USA (1996).

B. Reiss, et al., RecA stimulates sister chromatid exchange and the fidelity of double-strand break repair, but not gene targeting, in plants transformed by Agrobacterium, 97 Proc Natl Acad Sci USA (2000).

C. Mussolino, et al., A novel TALE nuclease scaffold enables high genome editing activity in combination with low toxicity, Nucleic Acids Res (2011).

Carlson et al., (2013) "Efficient nonmeiotic allele introgression in livestock using custom endonulceases." Proceedings of the National Academy of Sciences.

Carlson, D. F., W. Tan, et al. (2012). "Efficient TALEN-mediated gene knockout in livestock." Proceedings of the National Academy of Sciences.

D. A. McGrew & K. L. Knight, Molecular design and functional organization of the RecA protein, 38 Crit Rev Biochem Mol Biol (2003).

D. F. Carlson, et al., Strategies for selection marker free swine transgenesis using the Sleeping Beauty transposon system, 20 Transgenic Res (2011).

D. J. Blake, et al., Function and genetics of dystrophin and dystrophin-related proteins in muscle, 82 Physiol Rev (2002).

D. Y. Guschin, et al., A rapid and general assay for monitoring endogenous gene modification, 649 Methods Mol Biol (2010).

E. E. Perez, et al., Establishment of HIV-1 resistance in CD4+ T cells by genome editing using zinc-finger nucleases, 26 Nat Biotechnol (2008).

H. J. Lee, et al., Targeted chromosomal deletions in human cells using zinc finger nucleases, 20 Genome Res (2010).

H. J. Kim, et al., Targeted genome editing in human cells with zinc finger nucleases constructed via modular assembly, 19 Genome Res. (2009).

I.D. Carbery, et al., Targeted genome modification in mice using zinc-finger nucleases, 186 Genetics (2010).

J. C. Miller, et al., A TALE nuclease architecture for efficient genome editing, 29 Nature Biotech. (2011).

L. Grobet, et al., A deletion in the bovine myostatin gene causes the double-muscled phenotype in cattle, 17 Nat Genet (1997).

L. Tesson, et al., Knockout rats generated by embryo microinjection of TALENs, 29 Nat Biotechnol (2011).

Liao, H. K. and J. J. Essner (2011). "Use of RecA fusion proteins to induce genomic modifications in zebrafish." Nucleic acids research 39(10): 4166-4179.

M. Christian, et al., Targeting DNA double-strand breaks with TAL effector nucleases, 186 Genetics (2010).

M. M. Cox, Recombinational DNA repair in bacteria and the RecA protein, 63 Prog Nucleic Acid Res Mol Biol (1999).

Medugorac, I., D. Seichter, et al. (2012). "Bovine polled-ness—an autosomal dominant trait with allelic heterogeneity." PloS one 7(6): e39477.

N. Takahashi & I. B. Dawid, Characterization of zebrafish Rad52 and replication protein A for oligonucleotide-mediated mutagenesis, 33 Nucleic Acids Res (2005).

O. G. Shcherbakova, et al., Overexpression of bacterial RecA protein stimulates homologous recombination in somatic mammalian cells, 459 Mutat Res (2000).

R. J. Yanez & A. C. Porter, Gene targeting is enhanced in human cells overexpressing hRAD51, 6 Gene Ther (1999).

R. Kambadur, et al., Mutations in myostatin (GDF8) in double-muscled Belgian Blue and Piedmontese cattle, 7 Genome Res (1997).

T. Cermak, et al., Efficient design and assembly of custom TALEN and other TAL effector-based constructs for DNA targeting, (in press) Nucl. Acids Res. (2011).

T. Mashimo, et al., Generation of knockout rats with X-linked severe combined immunodeficiency (X-SCID) using zinc-finger nucleases, 5 PLoS One (2010).

Y. Doyon, et al., Transient cold shock enhances zinc-finger nuclease-mediated gene disruption, 7 Nat Methods (2010).

Z. Cui, et al., RecA-mediated, targeted mutagenesis in zebrafish, 5 March Biotechnol (NY) (2003).

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Lengthy table referenced here

US10893667-20210119-T00001

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US10893667B2). An electronic copy of the table will also be available from the USPTO upon request and payment of the fee set forth in 37 CFR 1.19(b)(3).

SEQUENCE LISTING (566 sequences)

SEQ ID NO: 1 - DNA, 71 bp, Bos taurus
ccctcttcctttcctccagggatccctcctacatggcctcccactggagaagcaacagaggagcacacaga

SEQ ID NO: 2 - DNA, 75 bp, Artificial Sequence
  Description of Artificial Sequence: Synthetic oligonucleotide
  modified_base (38)..(41): a, c, t, g, unknown or other
ccctcttcctttcctccagggatccctcctacagggannnnctcccactggagaagcaacagaggagcacacaga

SEQ ID NO: 3 - DNA, 78 bp, Artificial Sequence
  Description of Artificial Sequence: Synthetic oligonucleotide
  modified_base (33)..(44): a, c, t, g, unknown or other
ccctcttcctttcctccagggatccctcctacnnnnnnnnnnnnctcccactggagaagcaacagaggagcacacaga

SEQ ID NO: 4 - DNA, 71 bp, Bos taurus; identical to SEQ ID NO: 1

SEQ ID NO: 5 - DNA, 59 bp, Artificial Sequence
  Description of Artificial Sequence: Synthetic oligonucleotide
ccttcttcctttcctccagggatccctcccactggagaagcaacagaggagcacacaga

SEQ ID NO: 6 - DNA, 66 bp, Artificial Sequence
  Description of Artificial Sequence: Synthetic oligonucleotide
ccctcttcctttcctccagggatccctcctacttcccactggagaagcaacagaggagcacacaga

SEQ ID NO: 7 - DNA, 70 bp, Sus scrofa
gcccccccacacagctgagcccatgctgatggagtaccctgaggctataactcgcttggtgacagggtcc

SEQ ID NO: 8 - DNA, 91 bp, Artificial Sequence
  Description of Artificial Sequence: Synthetic oligonucleotide
gcccccccacacagctgagccacaagtcgagggtctcagagtcactgagtactgagtgctgatggagtaccctgaggctataactcgcttg

SEQ ID NO: 9 - DNA, 66 bp, Artificial Sequence
  Description of Artificial Sequence: Synthetic oligonucleotide
gcccccccacacagctgagccctgatggagtaccctgaggctataactcgcttggtgacagggtcc

SEQ ID NO: 10 - DNA, 69 bp, Artificial Sequence
  Description of Artificial Sequence: Synthetic oligonucleotide
gcccccccacacagctgagccatgctgatggagtaccctgaggctataactcgcttggtgacagggtcc

SEQ ID NO: 11 - DNA, 65 bp, Artificial Sequence
  Description of Artificial Sequence: Synthetic oligonucleotide
gcccccccacacagctgagcccaatggagtaccctgaggctataactcgcttggtgacagggtcc

SEQ ID NO: 12 - DNA, 65 bp, Artificial Sequence
  Description of Artificial Sequence: Synthetic oligonucleotide
gcccccccacacagctgagcacacaggagtaccctgaggctataactcgcttggtgacagggtcc

SEQ ID NO: 13 - DNA, 70 bp, Sus scrofa; identical to SEQ ID NO: 7

SEQ ID NO: 14 - DNA, 325 bp, Artificial Sequence
  Description of Artificial Sequence: Synthetic polynucleotide
gtctggggtgagatagttttcttggtaggctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttctttgctctttagatcaaaactctcttttcatttttaagtctatcccaaaagtgtgggaggtgtccttgatgttgaattataggcag

SEQ ID NO: 15 - DNA, 71 bp, Artificial Sequence
  Description of Artificial Sequence: Synthetic oligonucleotide
gcccccccacacagctgagcccattgctgatggagtaccctgaggctataactcgcttggtgacagggtcc

SEQ ID NO: 16 - DNA, 69 bp, Artificial Sequence
  Description of Artificial Sequence: Synthetic oligonucleotide
gcccccccacacagctgagcccagctgatggagtaccctgaggctataactcgcttggtgacagggtcc

SEQ ID NO: 17 - DNA, 67 bp, Artificial Sequence
  Description of Artificial Sequence: Synthetic oligonucleotide
gcccccccacacagctgagcccatgatggagtaccctgaggctataactcgcttggtgacagggtcc

SEQ ID NO: 18 - DNA, 69 bp, Artificial Sequence; identical to SEQ ID NO: 16
  Description of Artificial Sequence: Synthetic oligonucleotide

SEQ ID NO: 19 - DNA, 65 bp, Artificial Sequence; identical to SEQ ID NO: 11
  Description of Artificial Sequence: Synthetic oligonucleotide

SEQ ID NO: 20 - DNA, 69 bp, Artificial Sequence; identical to SEQ ID NO: 10
  Description of Artificial Sequence: Synthetic oligonucleotide

SEQ ID NO: 21 - DNA, 69 bp, Artificial Sequence; identical to SEQ ID NO: 10
  Description of Artificial Sequence: Synthetic oligonucleotide

SEQ ID NO: 22 - DNA, 67 bp, Artificial Sequence; identical to SEQ ID NO: 17
  Description of Artificial Sequence: Synthetic oligonucleotide

SEQ ID NO: 23 - DNA, 69 bp, Artificial Sequence
  Description of Artificial Sequence: Synthetic oligonucleotide
gcccccccacacagctgagcccatgtgatggagtaccctgaggctataactcgcttggtgacagggtcc

SEQ ID NO: 24 - DNA, 70 bp, Artificial Sequence
  Description of Artificial Sequence: Synthetic oligonucleotide
gcccccccacacagctgagccatgcctgatggagtaccctgaggctataactcgcttggtgacagggtcc

SEQ ID NO: 25 - DNA, 66 bp, Artificial Sequence; identical to SEQ ID NO: 9
  Description of Artificial Sequence: Synthetic oligonucleotide

SEQ ID NO: 26 - DNA, 97 bp, Bos taurus
tcgccttccctcttcctttcctccagggatccctcctacatggcctcccactggagaagcaacagaggagcacacagaaggcccttctgcaacggaa

SEQ ID NO: 27 - DNA, 97 bp, Artificial Sequence
  Description of Artificial Sequence: Synthetic oligonucleotide
tcgccttccctcttcctttcctccagggatccctcctacatggcttggcctcccactggagaagcaacagaggagcacacagaaggcccttctgcaa

SEQ ID NO: 28 - DNA, 96 bp, Artificial Sequence
  Description of Artificial Sequence: Synthetic oligonucleotide
tcgccttccctcttcctttcctccagggatccctcctacatggctcccactggagaagcaacagaggagcacacagaaggcccttctgcaacggaa

SEQ ID NO: 29 - DNA, 96 bp, Artificial Sequence
  Description of Artificial Sequence: Synthetic oligonucleotide
tcgccttccctcttcctttcctccagggatccctcctacatggctggcctcccactggagaagcaacagaggagcacacagaaggcccttctgcaa

SEQ ID NO: 30 - DNA, 94 bp, Artificial Sequence
  Description of Artificial Sequence: Synthetic oligonucleotide
tcgccttccctcttcctttcctccagggatccctcctacgcctcccactggagaagcaacagaggagcacacagaaggcccttctgcaacggaa

SEQ ID NO: 31 - DNA, 92 bp, Artificial Sequence
  Description of Artificial Sequence: Synthetic oligonucleotide
tcgccttccctcttcctttcctccagggatccctcctacttcccactggagaagcaacagaggagcacacagaaggcccttctgcaacggaa

SEQ ID NO: 32 - DNA, 91 bp, Artificial Sequence
  Description of Artificial Sequence: Synthetic oligonucleotide
tcgccttccctcttcctttcctccagggatccctcctactcccactggagaagcaacagaggagcacacagaaggcccttctgcaacggaa

SEQ ID NO: 33 - DNA, 91 bp, Artificial Sequence
  Description of Artificial Sequence: Synthetic oligonucleotide
tcgccttccctcttcctttcctccagggatccctcctgctcccactggagaagcaacagaggagcacacagaaggcccttctgcaacggaa

SEQ ID NO: 34 - DNA, 85 bp, Artificial Sequence
  Description of Artificial Sequence: Synthetic oligonucleotide
tcaccttccttcttcctttcctccagggatccctcccactggagaagcaacagaggagcacacagaaggcccttctgcaacggaa

SEQ ID NO: 35 - DNA, 85 bp, Artificial Sequence
  Description of Artificial Sequence: Synthetic oligonucleotide
tcgccttccctcttcctttcctccagggatccctcccactggagaagcaacagaggagcacacagaaggcccttctgcaacggaa

SEQ ID NO: 36 - DNA, 77 bp, Artificial Sequence
  Description of Artificial Sequence: Synthetic oligonucleotide
tcgccttccctcttcctttcctccagggatccctcctacatacagaggagcacacagaaggcccttctgcaacggaa

SEQ ID NO: 37 - DNA, 98 bp, Artificial Sequence
  Description of Artificial Sequence: Synthetic oligonucleotide
tcgccttccctcttcctttcctccagggatccctcctacattggcctcccactggagaagcaacagaggagcacacagaaggcccttctgcaacggaa

SEQ ID NO: 38 - DNA, 101 bp, Artificial Sequence
  Description of Artificial Sequence: Synthetic polynucleotide
tcgccttccctcttcctttcctccagggatccctcctacagggatcttctcccactggagaagcaacagaggagcacacagaaggcccttctgcaacggaa

SEQ ID NO: 39 - DNA, 17 bp, Sus scrofa
ctcctacaagtggattt

SEQ ID NO: 40 - DNA, 53 bp, Artificial Sequence
  Description of Artificial Sequence: Synthetic oligonucleotide
gacgggaaatgcatctcctacaagtgcacgaacagtccctataaacccctgga

SEQ ID NO: 41 - DNA, 53 bp, Artificial Sequence; identical to SEQ ID NO: 40
  Description of Artificial Sequence: Synthetic oligonucleotide

SEQ ID NO: 42 - DNA, 26 bp, Artificial Sequence
  Description of Artificial Sequence: Synthetic oligonucleotide
gacgggaaatgcatctcctacaagtg

SEQ ID NO: 43 - DNA, 53 bp, Artificial Sequence
  Description of Artificial Sequence: Synthetic oligonucleotide
aaatgcatctcctacaagtgcatttttgtttaaattaagatgtgggaggagaa

SEQ ID NO: 44 - DNA, 53 bp, Artificial Sequence; identical to SEQ ID NO: 43
  Description of Artificial Sequence: Synthetic oligonucleotide

SEQ ID NO: 45 - DNA, 25 bp, Artificial Sequence
  Description of Artificial Sequence: Synthetic oligonucleotide
aaatgcatctcctacaagtggattt

SEQ ID NO: 46 - DNA, 29 bp, Artificial Sequence
  Description of Artificial Sequence: Synthetic oligonucleotide
catctcctacaagtgcaaggacgggtccg

SEQ ID NO: 47 - DNA, 29 bp, Artificial Sequence
  Description of Artificial Sequence: Synthetic oligonucleotide
catctcctacaagtgcaaggacgggtccg

SEQ ID NO: 48 - DNA, 53 bp, Artificial Sequence
  Description of Artificial Sequence: Synthetic oligonucleotide
catctcctacaagtggatttgtgatgggaacaccgagtgcaaggacgggtccg

SEQ ID NO: 49 - DNA, 23 bp, Artificial Sequence
  Description of Artificial Sequence: Synthetic oligonucleotide
ctcctacaaggacgggtccgatg

SEQ ID NO: 50 - DNA, 23 bp, Artificial Sequence
  Description of Artificial Sequence: Synthetic oligonucleotide
ctcctacaaggacgggtccgatg

SEQ ID NO: 51 - DNA, 53 bp, Artificial Sequence
  Description of Artificial Sequence: Synthetic oligonucleotide
ctcctacaagtggatttgtgatgggaacaccgagtgcaaggacgggtccgatg

SEQ ID NO: 52 - DNA, 41 bp, Artificial Sequence
  Description of Artificial Sequence: Synthetic oligonucleotide
cctacaagtggatttgtgagtgcaaggacgggtccgatgag

SEQ ID NO: 53 - DNA, 41 bp, Artificial Sequence; identical to SEQ ID NO: 52
  Description of Artificial Sequence: Synthetic oligonucleotide

SEQ ID NO: 54 - DNA, 53 bp, Artificial Sequence
  Description of Artificial Sequence: Synthetic oligonucleotide
cctacaagtggatttgtgatgggaacaccgagtgcaaggacgggtccgatgag

SEQ ID NO: 55 - DNA, 79 bp, Sus scrofa
gccacacaacgactggaacatgcattcaacatcgccaagtatcagttaggcatagagaaactactggatcctgaaggtt

SEQ ID NO: 56 - DNA, 75 bp, Artificial Sequence
  Description of Artificial Sequence: Synthetic oligonucleotide
gccacacaacgactggaacatgcattcaacatcgccatcagttaggcatagagaaactactggatcctgaaggtt

SEQ ID NO: 57 - DNA, 72 bp, Artificial Sequence
  Description of Artificial Sequence: Synthetic oligonucleotide
gccacacaacgactggaacatgcattcaacatcgccagttaggcatagagaaactactggatcctgaaggtt

SEQ ID NO: 58 - DNA, 69 bp, Artificial Sequence
  Description of Artificial Sequence: Synthetic oligonucleotide
gccacacaacgactggaacatgcattcaacatcagttaggcatagagaaactactggatcctgaaggtt

SEQ ID NO: 59 - DNA, 431 bp, Artificial Sequence
  Description of Artificial Sequence: Synthetic polynucleotide
  modified_base (38)..(394): a, c, t, g, unknown or other
gccacacaacgactggaacatgcattcaacatcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttaggcatagagaaactactggatcctgaaggtt

SEQ ID NO: 60 - DNA, 405 bp, Artificial Sequence
  Description of Artificial Sequence: Synthetic polynucleotide
  modified_base (41)..(366): a, c, t, g, unknown or other
gccacacaacgactggaacatgcattcaacatcgccaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagttaggcatagagaaactactggatcctgaaggtt

SEQ ID NO: 61 - DNA, 79 bp, Sus scrofa; identical to SEQ ID NO: 55

SEQ ID NO: 62 - DNA, 84 bp, Artificial Sequence
  Description of Artificial Sequence: Synthetic oligonucleotide
  modified_base (44)..(46): a, c, t, g, unknown or other
cccacacaacgactggaacatgcattcaacatcgcataatatannntcagttaggcatagagaaactactggatcctgaaggtt

SEQ ID NO: 63 - DNA, 77 bp, Artificial Sequence
  Description of Artificial Sequence: Synthetic oligonucleotide
gccacacaacgactggaacatgcattcaacatcgccaaatcagttaggcatagagaaactactggatcctgaaggtt

SEQ ID NO: 64 - DNA, 69 bp, Artificial Sequence; identical to SEQ ID NO: 58
  Description of Artificial Sequence: Synthetic oligonucleotide

SEQ ID NO: 65 - DNA, 82 bp, Artificial Sequence
  Description of Artificial Sequence: Synthetic oligonucleotide
  modified_base (42)..(44): a, c, t, g, unknown or other
gccacacaacgactggaacatgcattcaacatcgccaagtannntcagttaggcatagagaaactactggatcctgaaggtt

SEQ ID NO: 66 - DNA, 76 bp, Artificial Sequence
  Description of Artificial Sequence: Synthetic oligonucleotide
gccacacaacgactggaacatgcattcaacatcgccaatcagttaggcatagagaaactactggatcctgaaggtt

SEQ ID NO: 67 - DNA, 75 bp, Artificial Sequence
  Description of Artificial Sequence: Synthetic oligonucleotide
gccacacaacgactggaacatgcattcaacatcgccaagtattaggcatagagaaactactggatcctgaaggtt

SEQ ID NO: 68 - DNA, 78 bp, Sus scrofa
gggaaatgcatctcctacaagtggatttgtgatgggaacaccgagtgcaaggacgggtccgatgagtccctggagacg

SEQ ID NO: 69 - DNA, 82 bp, Artificial Sequence
  Description of Artificial Sequence: Synthetic oligonucleotide
gggaaatgcatctcctacaagtggatttgtgatgggggaacaccgagtgcagggacgggtcataagagtccctggagacgtg

SEQ ID NO: 70 - DNA, 74 bp, Artificial Sequence
  Description of Artificial Sequence: Synthetic oligonucleotide
gggaaatgcatctcctacaagtggatttgtggaacaccgagtgcaaggacgggtccgatgagtccctggagacg

SEQ ID NO: 71 - DNA, 74 bp, Artificial Sequence; identical to SEQ ID NO: 70
  Description of Artificial Sequence: Synthetic oligonucleotide

SEQ ID NO: 72 - DNA, 74 bp, Artificial Sequence; identical to SEQ ID NO: 70
  Description of Artificial Sequence: Synthetic oligonucleotide

SEQ ID NO: 73 - DNA, 69 bp, Artificial Sequence
  Description of Artificial Sequence: Synthetic oligonucleotide
gggaaatgcatctcctacaagtggatttgcaccgagtgcaaggacgggtccgatgagtccctggagacg

SEQ ID NO: 74 - DNA, 69 bp, Artificial Sequence
  Description of Artificial Sequence: Synthetic oligonucleotide
gggaaatgcatctcctacaagtggacttgcaccgagtgcaaggacgggtccgatgagtccctggagacg

SEQ ID NO: 75 - DNA, 66 bp, Artificial Sequence
  Description of Artificial Sequence: Synthetic oligonucleotide
gggaaatgcatctcctacaagtggatttgtgagtgcaaggacgggtccgatgagtccctggagacg

SEQ ID NO: 76 - DNA, 66 bp, Artificial Sequence; identical to SEQ ID NO: 75
  Description of Artificial Sequence: Synthetic oligonucleotide

SEQ ID NO: 77 - DNA, 54 bp, Artificial Sequence
  Description of Artificial Sequence: Synthetic oligonucleotide
gggaaatgcatctcctacaagtgcaaggacgggtccgatgagtccctggagacg

SEQ ID NO: 78 - DNA, 48 bp, Artificial Sequence
  Description of Artificial Sequence: Synthetic oligonucleotide
gggaaatgcatctcctacaaggacgggtccgatgagtccctggagaag

SEQ ID NO: 79 - DNA, 50 bp, Artificial Sequence
  Description of Artificial Sequence: Synthetic oligonucleotide
gggaaatgcatctcctacaagtggacgggtccgatgagtccctggagacg

SEQ ID NO: 80 - DNA, 50 bp, Artificial Sequence
  Description of Artificial Sequence: Synthetic oligonucleotide
tgctgatcctggcactgatcaaggacgggtccgatgagtccctggagacg

SEQ ID NO: 81 - DNA, 50 bp, Artificial Sequence; identical to SEQ ID NO: 79
  Description of Artificial Sequence: Synthetic oligonucleotide

SEQ ID NO: 82 - DNA, 50 bp, Artificial Sequence; identical to SEQ ID NO: 80
  Description of Artificial Sequence: Synthetic oligonucleotide

SEQ ID NO: 83 - DNA, 41 bp, Artificial Sequence
  Description of Artificial Sequence: Synthetic oligonucleotide
tagacacagggagtatggtcacttgctgattcccaccgagt

SEQ ID NO: 84 - DNA, 69 bp, Artificial Sequence; identical to SEQ ID NO: 73
  Description of Artificial Sequence: Synthetic oligonucleotide

SEQ ID NO: 85 - DNA, 70 bp, Artificial Sequence
  Description of Artificial Sequence: Synthetic oligonucleotide
gggaaatgcatctcctacaagtggatttgtgatgggaacaccgagtgcaaggacgggtccgatgagtccc

SEQ ID NO: 86 - DNA, 77 bp, Artificial Sequence
  Description of Artificial Sequence: Synthetic oligonucleotide
gggaaatgcatctcctacaagtgcaaggagtgcaaggacggaatgcaccgagtgcaaggacgggtccgatgagtccc

SEQ ID NO: 87 - DNA, 56 bp, Artificial Sequence
  Description of Artificial Sequence: Synthetic oligonucleotide
gggaaatgcatctcctacaagttgcattccgctgtgaattaggatgtgggcggaga

SEQ ID NO: 88 - DNA, 75 bp, Artificial Sequence
  Description of Artificial Sequence: Synthetic oligonucleotide
gggaaatgcatctcctacaagtggatttgtgatgacaccgagtgcaaggacgggtccgatgagtccctggagacg

SEQ ID NO: 89 - DNA, 54 bp, Artificial Sequence
  Description of Artificial Sequence: Synthetic oligonucleotide
ggctcatttctcagcttgcagtgcaaggacgggtccggtgagtccctggagacg

SEQ ID NO: 90 - DNA, 76 bp, Artificial Sequence
  Description of Artificial Sequence: Synthetic oligonucleotide
gggaaatgcatctcctacaagtggatttgtgatacacaccgagtgcaaggacgggtccgatgagtccctggagacg

SEQ ID NO: 91 - DNA, 62 bp, Sus scrofa
tctatacctaggtcaaaaatgtaatgaagaaagtatcagttaggcatagagaaactactgga

SEQ ID NO: 92 - DNA, 52 bp, Artificial Sequence
  Description of Artificial Sequence: Synthetic oligonucleotide
tctatacctaggtcaaaaatgtaattcagttaggcatagagaaactactgga

SEQ ID NO: 93 - DNA, 54 bp, Artificial Sequence
  Description of Artificial Sequence: Synthetic oligonucleotide
tctatacctaggtcaaaaatgtaatgatcagttaggcatagagaaactactgga

SEQ ID NO: 94 - DNA, 62 bp, Artificial Sequence
  Description of Artificial Sequence: Synthetic oligonucleotide
tctatacctaggtcaaaaatgtaatgagacaggtatcagttaggcatagagaaactactgga

SEQ ID NO: 95 - DNA, 44 bp, Artificial Sequence
  Description of Artificial Sequence: Synthetic oligonucleotide
tctatacctaggtcaaaaatgttaggcatagagaaactactgga

SEQ ID NO: 96 - DNA, 43 bp, Artificial Sequence
  Description of Artificial Sequence: Synthetic oligonucleotide
tctatacctaggtcaaaaatgtaggcatagagaaactactgga

SEQ ID NO: 97 - DNA, 51 bp, Artificial Sequence
  Description of Artificial Sequence: Synthetic oligonucleotide
tctatacctaggtcaaaaatgtaatcagttaggcatagagaaactactgga

SEQ ID NO: 98 - DNA, 58 bp, Artificial Sequence
  Description of Artificial Sequence: Synthetic oligonucleotide
tctatacctaggtcaaaaatgtaatgaagtatcagttaggcatagagaaactactgga

SEQ ID NO: 99 - DNA, 61 bp, Artificial Sequence
  Description of Artificial Sequence: Synthetic oligonucleotide
tctatacctaggtcaaaaatgcaatgaagaaatatcagttaggcatagagaaactactgga

SEQ ID NO: 100 - DNA, 62 bp, Artificial Sequence
  Description of Artificial Sequence: Synthetic oligonucleotide
tctatacctaggtcaaaaatgtaatgaattaaatatcagttaggcatagagaaactactgga

SEQ ID NO: 101 - DNA, 60 bp, Artificial Sequence
  Description of Artificial Sequence: Synthetic oligonucleotide
tcaatacctaggtcagaaatgtaatgaagagtatcagttaggcatagagaaactactgga

SEQ ID NO: 102 - DNA, 56 bp, Artificial Sequence
  Description of Artificial Sequence: Synthetic oligonucleotide
tctatacctaggtcaaaaatgtaaaggtatcagttaggcatagagaaactactgga

SEQ ID NO: 103 - DNA, 63 bp, Artificial Sequence
  Description of Artificial Sequence: Synthetic oligonucleotide
tctatacctaggtcaaaaatgtaatgaaaaggggtatcagttaggcatagagaaactactgga

SEQ ID NO: 104 - DNA, 48 bp, Artificial Sequence
  Description of Artificial Sequence: Synthetic oligonucleotide
tctatacctaggtcaaaattatcagttaggcatagagaaactactgga

SEQ ID NO: 105 - DNA, 54 bp, Artificial Sequence
  Description of Artificial Sequence: Synthetic oligonucleotide
tctatacctaggtcaaaaatgtaagaatcagttaggcatagagaaactactgga

SEQ ID NO: 106 - DNA, 81 bp, Artificial Sequence
  Description of Artificial Sequence: Synthetic oligonucleotide
gaaattttctttctatacctatgtcaaaaatgtaatgaaacttggcgatgttgaatgcatgttccagtcgttgtgtggctg

SEQ ID NO: 107 - DNA, 77 bp, Artificial Sequence
  Description of Artificial Sequence: Synthetic oligonucleotide
gaaattttctttctatacctatgtcaaaaatgtaatgatggcgatgttgaatgcatgttccagtcgttgtgtggctg

SEQ ID NO: 108 - DNA, 60 bp, Artificial Sequence
  Description of Artificial Sequence: Synthetic oligonucleotide
gaaattttctttctatacctagggcgatgttgaatgcatgttccagtcgttgtgtggctg

SEQ ID NO: 109 - DNA, 73 bp, Artificial Sequence
  Description of Artificial Sequence: Synthetic oligonucleotide
gaaattttctttctatacctaggtcaaaaatgtatggcgatgttgaatgcatgttccagtcgttgtgtggctg

SEQ ID NO: 110 - DNA, 82 bp, Artificial Sequence
  Description of Artificial Sequence: Synthetic oligonucleotide
gaaattttctttctatacctaggtcaaaaatgtaatgaagacttggcgatgttgaatgcatgttccagtcgctgtgtggctg

SEQ ID NO: 111 - DNA, 86 bp, Artificial Sequence
  Description of Artificial Sequence: Synthetic oligonucleotide
gaaattttctttcgatacctaggtcaaaaatgtaatgaagatctacttggcgatgttgaatgcatgttccagtcgttgtgtggctg

SEQ ID NO: 112 - DNA, 87 bp, Artificial Sequence
  Description of Artificial Sequence: Synthetic oligonucleotide
gaaattttctttctatacctaggtcaaaaatgtaatgaagatgatacttggcgatgttgaatgcatgttccagtcgttgtgtggctg

SEQ ID NO: 113 - DNA, 79 bp, Artificial Sequence
  Description of Artificial Sequence: Synthetic oligonucleotide
ttttcactgttagtttgttgcaatccagccatgatattcatcagttaggcatagagaaactactggatcctgaaggtta

SEQ ID NO: 114 - DNA, 84 bp, Artificial Sequence
  Description of Artificial Sequence: Synthetic oligonucleotide
ttttcactgttagtttgttgcaatccagccatgatattcttagtatcagttaggcatagagaaactactggatcctgaaggtta

SEQ ID NO: 115 - DNA, 79 bp, Artificial Sequence
  Description of Artificial Sequence: Synthetic oligonucleotide
ttttcactgttggtttgttgcaatccagccaagatatatatcagttaggcatagagcaactactggatcctgaaggtta

SEQ ID NO: 116 - DNA, 59 bp, Bos taurus
tgtgatgaacactccacagaatctcgatgctgtcgttaccctctaactgtggattttga

SEQ ID NO: 117 - DNA, 48 bp, Artificial Sequence
  Description of Artificial Sequence: Synthetic oligonucleotide
tgtgacagaatctcgatgctgtcgttaccctctaactgtggattttga

SEQ ID NO: 118 - DNA, 59 bp, Artificial Sequence
  Description of Artificial Sequence: Synthetic oligonucleotide
ttgggcttgattgtgacagaatctcgatgctgtcgttaccctctaactgtggattttga

SEQ ID NO: 119 - DNA, 11 bp, Bos taurus
atgaacactcc

SEQ ID NO: 120 - DNA, 33 bp, Bos taurus
cttgattgtgatgaacactccacagaatctcga

SEQ ID NO: 121 - DNA, 22 bp, Artificial Sequence
  Description of Artificial Sequence: Synthetic oligonucleotide
cttgattgtgacagaatctcga

SEQ ID NO: 122 - DNA, 22 bp, Artificial Sequence
  Description of Artificial Sequence: Synthetic oligonucleotide
cttgattgtgacagaatctcga

SEQ ID NO: 123 - DNA, 22 bp, Artificial Sequence
  Description of Artificial Sequence: Synthetic oligonucleotide
cttgattgtgacagaatctcga

SEQ ID NO: 124 - DNA, 22 bp, Artificial Sequence
  Description of Artificial Sequence: Synthetic oligonucleotide
cttgattgtgacagaatctcga

SEQ ID NO: 125 - DNA, 22 bp, Artificial Sequence
  Description of Artificial Sequence: Synthetic oligonucleotide
cttgattgtgacagaatctcga

SEQ ID NO: 126 - DNA, 22 bp, Artificial Sequence
  Description of Artificial Sequence: Synthetic oligonucleotide
cttgattgtgacagaatctcga

SEQ ID NO: 127 - DNA, 22 bp, Artificial Sequence
  Description of Artificial Sequence: Synthetic oligonucleotide
cttgattgtgacagaatctcga

SEQ ID NO: 128 - DNA, 22 bp, Artificial Sequence
  Description of Artificial Sequence: Synthetic oligonucleotide
cttgattgtgacagaatctcga

SEQ ID NO: 129 - protein, 440 aa, Artificial Sequence
  Description of Artificial Sequence: Synthetic polypeptide
MASSPPKKKRKVSWKDASGWSRVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAMEAVHASRNALTGAPLNLTPDQVVAIASNGGGKQALESIVAQLSRPDPALAALTNDHLVALACLGGRPAMDAVKKGLPHAPELIRRVNRRIGERTSHRVASRSQLVKSFLEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 130 - protein, 459 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNGGGRPALESIVAQLSRPDPALAALTNDHLVALACLGGRPALDAVKKGLPHAPALIKRVNRRIPERTSHRVAGSQLVKSFLEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 131 - DNA, 4650 bp, Artificial Sequence
  Description of Artificial Sequence: Synthetic polynucleotide
catgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctggagacgggcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccaccggtcgtctccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctca

SEQ ID NO: 132 - protein, 22 aa, Artificial Sequence
  Description of Artificial Sequence: Synthetic peptide
MASSPPKKKRKVSWKDASGWSR

SEQ ID NO: 133 - DNA, 76 bp, Artificial Sequence
  Description of Artificial Sequence: Synthetic oligonucleotide
ggagagattttgggcttgattgtgacagaatctcgatgctgtcgttaccctctaactgtggattttgaagcttttg

SEQ ID NO: 134 - DNA, 76 bp, Artificial Sequence
  Description of Artificial Sequence: Synthetic oligonucleotide
caaaagcttcaaaatccacagttagagggtaacgacagcatcgagattctgtcacaatcaagcccaaaatctctcc

SEQ ID NO: 135 - DNA, 34 bp, Artificial Sequence
  Description of Artificial Sequence: Synthetic oligonucleotide
actccacagaatctcgatgctctaactgtggatt

SEQ ID NO: 136 - DNA, 39 bp, Artificial Sequence
  Description of Artificial Sequence: Synthetic oligonucleotide
actccacagaatctcgatgctaccctctaactgtggatt

SEQ ID NO: 137 - DNA, 28 bp, Artificial Sequence
  Description of Artificial Sequence: Synthetic oligonucleotide
actccacagaatcctctaactgtggatt

SEQ ID NO: 138 - DNA, 41 bp, Artificial Sequence
  Description of Artificial Sequence: Synthetic oligonucleotide
actccacagaatctcgatgctgttacctctaactgtggatt

SEQ ID NO: 139 - DNA, 44 bp, Artificial Sequence
  Description of Artificial Sequence: Synthetic oligonucleotide
actccacagaatctcgatgcttcgttaccctctaactgtggatt

SEQ ID NO: 140 - DNA, 49 bp, Sus scrofa
ctcctacaagtggattgtgatgggaacaccgagtgcaaggacgggtccg

SEQ ID NO: 141 - DNA, 84 bp, Artificial Sequence
  Description of Artificial Sequence: Synthetic oligonucleotide
  modified_base (27)..(60): a, c, t, g, unknown or other
ctcctacaagtggatttgtgatgggannnnnnnnnnnnnnnnnnnnnnnnnnnnnnnnnnacaccgagtgcaaggacgggtccg

SEQ ID NO: 142 - DNA, 47 bp, Artificial Sequence
  Description of Artificial Sequence: Synthetic oligonucleotide
ctcctacaagtggatttgtgggaacaccgagtgcaaggacgggtccg

SEQ ID NO: 143 - DNA, 37 bp, Artificial Sequence
  Description of Artificial Sequence: Synthetic oligonucleotide
agggagtatggtcacaccgagtgcaaggacgggtccg

SEQ ID NO: 144 - DNA, 40 bp, Artificial Sequence
  Description of Artificial Sequence: Synthetic oligonucleotide
ctcctacaagtggatttgtgatggggcaaggacgggtccg

SEQ ID NO: 145 - DNA, 51 bp, Artificial Sequence
  Description of Artificial Sequence: Synthetic oligonucleotide
ctcctacaagtggatttgtgatgggaaacaccgagtgcaaggacgggtccg

SEQ ID NO: 146 - DNA, 65 bp, Artificial Sequence
  Description of Artificial Sequence: Synthetic oligonucleotide
ggccaattactgctctggagagtatgaattcgtatttttacaaaaataccctcacactcatcttg

SEQ ID NO: 147 - DNA, 45 bp, Bos taurus
actccacagaatctcgatgctgtcgttaccctctaactgtggatt

SEQ ID NO: 148 - DNA, 42 bp, Artificial Sequence
  Description of Artificial Sequence: Synthetic oligonucleotide
actccacagaatctcgatgctgttaccctctaactgtggatt

SEQ ID NO: 149 - DNA, 20 bp, Artificial Sequence
  Description of Artificial Sequence: Synthetic oligonucleotide
tagatcaaaactctcttttc

SEQ ID NO: 150 - DNA, 15 bp, Artificial Sequence
  Description of Artificial Sequence: Synthetic oligonucleotide
tttcttggtaggctg

SEQ ID NO: 151 - DNA, 17 bp, Artificial Sequence
  Description of Artificial Sequence: Synthetic oligonucleotide
atcaaaactctcttttc

SEQ ID NO: 152 - DNA, 15 bp, Artificial Sequence
  Description of Artificial Sequence: Synthetic oligonucleotide
tcttggtaggctggt

SEQ ID NO: 153 - DNA, 15 bp, Artificial Sequence
  Description of Artificial Sequence: Synthetic oligonucleotide
caaaactctcttttc

SEQ ID NO: 154 - DNA, 18 bp, Artificial Sequence
  Description of Artificial Sequence: Synthetic oligonucleotide
ggaagaagtatcagccat

SEQ ID NO: 155 - DNA, 16 bp, Artificial Sequence
  Description of Artificial Sequence: Synthetic oligonucleotide
acagaaattctgggtc

SEQ ID NO: 156 - DNA, 86 bp, Sus scrofa
ccagatcgccaaagtcatggaagaagtatcagccattcatccctcccaggaagacagaaattctgggtcaaccacggagttgcact

SEQ ID NO: 157 - DNA, 23 bp, Artificial Sequence
  Description of Artificial Sequence: Synthetic oligonucleotide
gaatttctgtcttcctgggaggg

SEQ ID NO: 158 - DNA, 90 bp, Artificial Sequence
  Description of Artificial Sequence: Synthetic oligonucleotide
ccagatcgccaaagtcacggaagaagtatcagccattcatccctcccagtgaagcttacagaaattctgggtcgaccacggagttgcact

SEQ ID NO: 159 - DNA, 23 bp, Artificial Sequence
  Description of Artificial Sequence: Synthetic primer
aaggatgtcagcacctctctggg

SEQ ID NO: 160 - DNA, 25 bp, Artificial Sequence
  Description of Artificial Sequence: Synthetic primer
acccacccggactctactcctacca

SEQ ID NO: 161 - DNA, 50 bp, Artificial Sequence
  Description of Artificial Sequence: Synthetic oligonucleotide
acaaccctctcagccttcgctttgggaaacgctacaatggctacatttac

SEQ ID NO: 162 - DNA, 54 bp, Artificial Sequence
  Description of Artificial Sequence: Synthetic oligonucleotide
cgctttgggaaacgctacaatggctacatttacagaagagctgttaaaagagcc

SEQ ID NO: 163 - DNA, 58 bp, Artificial Sequence
  Description of Artificial Sequence: Synthetic oligonucleotide
ccccttcaccgccaccctttaccccctccctggatggatctttggcaacttcatgtgc

SEQ ID NO: 164 - DNA, 55 bp, Artificial Sequence
  Description of Artificial Sequence: Synthetic oligonucleotide
ctaccccctgaaatctcttcggcaccgaacccccaaagtagccatgattgtcagc

SEQ ID NO: 165 - DNA, 21 bp, Artificial Sequence
  Description of Artificial Sequence: Synthetic primer
gccactgacatcatcttcttg

SEQ ID NO: 166 - DNA, 20 bp, Artificial Sequence
  Description of Artificial Sequence: Synthetic primer
gaaacagaaagttgaagtgg

SEQ ID NO: 167 - DNA, 23 bp, Artificial Sequence
  Description of Artificial Sequence: Synthetic primer
tcaccctgactgctatgagtgga

SEQ ID NO: 168 - DNA, 23 bp, Artificial Sequence
  Description of Artificial Sequence: Synthetic primer
atgagtcagtcgataatgacacg

SEQ ID NO: 169 - DNA, 21 bp, Artificial Sequence
  Description of Artificial Sequence: Synthetic primer
ttatgcaaaagaagaaaggtg

SEQ ID NO: 170 - DNA, 24 bp, Artificial Sequence
  Description of Artificial Sequence: Synthetic primer
gcagagttcgacctactttcattg

SEQ ID NO: 171 - DNA, 24 bp, Artificial Sequence
  Description of Artificial Sequence: Synthetic primer
tatacatagcccccattttcagtg

SEQ ID NO: 172 - DNA, 19 bp, Artificial Sequence
  Description of Artificial Sequence: Synthetic primer
ggcagcaggtaggcagcaa

SEQ ID NO: 173 - DNA, 23 bp, Artificial Sequence
  Description of Artificial Sequence: Synthetic primer
gtcctctgcattcaggagaacag

SEQ ID NO: 174 - DNA, 24 bp, Artificial Sequence
  Description of Artificial Sequence: Synthetic primer
ctaaaagtattttatttacatagt

SEQ ID NO: 175 - DNA, 21 bp, Artificial Sequence
  Description of Artificial Sequence: Synthetic primer
aggcagctcctttgcaatgat

SEQ ID NO: 176 - DNA, 21 bp, Artificial Sequence
  Description of Artificial Sequence: Synthetic primer
agagaagggtgaaaacttttt

SEQ ID NO: 177 - DNA, 12 bp, Artificial Sequence
  Description of Artificial Sequence: Synthetic oligonucleotide
ttctcagaatag

SEQ ID NO: 178 - DNA, 325 bp, Artificial Sequence; identical to SEQ ID NO: 14
  Description of Artificial Sequence: Synthetic polynucleotide

SEQ ID NO: 179 - DNA, 59 bp, Bos taurus; identical to SEQ ID NO: 116

SEQ ID NO: 180 - DNA, 48 bp, Artificial Sequence; identical to SEQ ID NO: 117
  Description of Artificial Sequence: Synthetic oligonucleotide

SEQ ID NO: 181 - DNA, 59 bp, Artificial Sequence; identical to SEQ ID NO: 118
  Description of Artificial Sequence: Synthetic oligonucleotide

SEQ ID NO: 182 - DNA, 61 bp, Sus scrofa
tagatggatgaaaccgaaattagaagtttctttgctagatatggttcagtaaaagaagtga

SEQ ID NO: 183 - DNA, 65 bp, Artificial Sequence
  Description of Artificial Sequence: Synthetic oligonucleotide
tagacggatgaaaccgaaattagaagttggatcctttgctagatatggttcagtaaaaggagtga

SEQ ID NO: 184 - DNA, 65 bp, Artificial Sequence; identical to SEQ ID NO: 183
  Description of Artificial Sequence: Synthetic oligonucleotide

SEQ ID NO: 185 - DNA, 29 bp, Artificial Sequence
  Description of Artificial Sequence: Synthetic oligonucleotide
tagatggatgaaaccgaaattagaagtga

SEQ ID NO: 186 - DNA, 39 bp, Artificial Sequence
  Description of Artificial Sequence: Synthetic oligonucleotide
tagatggatgaaaccgatatggttcagtaaaagaagtga

SEQ ID NO: 187 - DNA, 35 bp, Artificial Sequence
  Description of Artificial Sequence: Synthetic oligonucleotide
tagatggactagatatggttcagtaaaagaagtga

SEQ ID NO: 188 - DNA, 61 bp, Sus scrofa
tcatggaagaagtatcagccattcatccctcccaggaagacagaaattctgggtcaaccac

SEQ ID NO: 189 - DNA, 65 bp, Artificial Sequence
  Description of Artificial Sequence: Synthetic oligonucleotide
tcacggaagaagtatcagccattcatccctcccagtgaagcttacagaaattctgggtcagccac

SEQ ID NO: 190 - DNA, 65 bp, Artificial Sequence
  Description of Artificial Sequence: Synthetic oligonucleotide
tcatggaagaagtatcagccattcatccctcccagtgaagcttacagaaattctgggtcaaccac

SEQ ID NO: 191 - DNA, 64 bp, Artificial Sequence
  Description of Artificial Sequence: Synthetic oligonucleotide
tcatggaagaagtatcagccattcatccctccccccaggaagacagaaattctgggtcaaccac

SEQ ID NO: 192 - DNA, 65 bp, Artificial Sequence
  Description of Artificial Sequence: Synthetic oligonucleotide
tcatggaagaagtatcagccattcatccctcccagtgaagcttacagaaattctgggtcagccac

SEQ ID NO: 193 - DNA, 61 bp, Artificial Sequence; identical to SEQ ID NO: 188
  Description of Artificial Sequence: Synthetic oligonucleotide

SEQ ID NO: 194 - DNA, 65 bp, Artificial Sequence
  Description of Artificial Sequence: Synthetic oligonucleotide
tcacggaagaagtatcagccattcatccctcccagtgaagcttacagaaattctgggtcaaccac

SEQ ID NO: 195 - DNA, 58 bp, Artificial Sequence
  Description of Artificial Sequence: Synthetic oligonucleotide
tcatggaagaagtatcagccattcatccctccgaagacagaaactctgggtcaaccac

SEQ ID NO: 196 - DNA, 90 bp, Sus scrofa
gtgctgcgtgccctttactgctctactctaccccctaccagcctgggtgctgggcgacttcatgtgcaagttcctcaactacatccagca

SEQ ID NO: 197 - DNA, 90 bp, Artificial Sequence
  Description of Artificial Sequence: Synthetic oligonucleotide
  modified_base (45)..(46): a, c, t, g, unknown or other
  modified_base (48)..(50): a, c, t, g, unknown or other
gtgctgcgtgccctttactgctctactctaccccctaccagcctnngnnngtgctgggcgacttcatgtgcaagttcctcaactacatcc

SEQ ID NO: 198 - DNA, 630 bp, Oreochromis niloticus
acatggggagacaaacaatttttggatctggtgctgaaagatgagactactggctttggctgtggtttgcgctctcattgctatccaggatggagggagtgtgggagcagctctgccaggagtcgaccctgcacagagaacacatgcaacaggagcagtgtcctctgcattcaggagaacagcaggcgacttcctggcagaggatcccagcctctgcttttccctgagagagaacgaggaccagaggcagctcctttgcaatgatcgcagaagtaatttcaactacaaccctctcagccttcgctttgggaaacgctacaatggctacatttacagaagagctgttaaaagagccagaacaaaaaagttttcacccttctctctgttcttgcgagaactggaggtacccacctgaaacagaagactttctctggggaattatgttatttgtttggaaagtcaaactgtgacagcagtgttcttaaaactctttatttcagaaaaaaaggtttccctgattaaaacttttgcacctatctttaatgtaaaataattttcagatgctacaatggagagaactatgtaaataaaatacttttagagagctaaaaaaaaaaaaaaaaaaaaaaa

SEQ ID NO: 199 - protein, 169 aa, Oreochromis niloticus
MRLLALAVVCALIAIQDGGSVGAALPGVDPAQRTHATGAVSSAFRRTAGDFLAEDPSLCFSLRENEDQRQLLCNDRRSNFNYNPLSLRFGKRYNGYIYRRAVKRARTKKFSPFSLFLRELEVPTNRRLSLGNYVICLESQTVTAVFLKLFISEKKVSLIKTFAPIFNVK

SEQ ID NO: 200 - protein, 390 aa, Oreochromis niloticus
  MOD_RES (48)..(48): Asp or Asn
MYSSEELWNSTEQVWINGSGTNFSLGRHEDDEEEEGDKHPFFTDAWLXPLFFSLIMLVGLVGNSLVIYVISKHRQMRTATNFYIANLAATDIIFLVCCVPFTATLYPLPGWIFGNFMCKFVAFLQQVTVQATCITLTAMSGDRCYVTVYPLKSLRHRTPKVAMIVSICIWIGSFVLSTPILMYQRIEEGYWYGPRQYCMERFPSKTHERAFILYQFIAAYLLPVLTISFCYTLMVKRVGQPTVEPVDNNYQVNLLSERTISIRSKVSKMVVVIVLLFAICWGPIQIFVLFQSFYPNYQPNYATYKIKTWANCMSYANSSVNPIVYGFMGASFQKSFRKTFPFLFKHKVRDSSMASRTANAEIKFVAAEEGNNNNAVNSRSFNIRRIGTVF

SEQ ID NO: 201 - DNA, 1215 bp, Oreochromis niloticus
aactcctgtcacgatgtactcctccgaggagctgtggaactccaccgagcaggtctggatcaacggatccggaacaaacttctctctaggaagacacgaggacgatgaggaggaggaaggagacaagcatcctttcttcacggatgcctggctggtccctctgttcttctctctcatcatgctggtcggactggtgggcaactctctggtcatttatgtcatttcaaaacacagacagatgaggacggcaaccaacttctacatagcaaacctggccgccactgacatcatcttcttggtgtgctgcgtccccttcaccgccaccctttaccccctccctggatggatctttggcaacttcatgtgcaaatttgtcgcctttctgcagcaggtgacggtgcaagccacctgcatcaccctgactgctatgagtggagaccgctgttacgtgacagrctaccccctgaaatctcttcggcaccgaacccccaaagtagccatgattgtcagcatttgcatttggatcggttctttcgtcctctctacaccaattttaatgtaccagcgtatagaggagggctactggtacggcccgaggcaatactgcatggagagatttccctctaagacgcatgagagggctttcatcctgtaccagttcattgctgcctacctgctgcctgtgctcactatctctttctgctacactctgatggttaagagggttggccagcccactgtagaacctgtagacaataattatcaggtgaatctcctgtctgagagaacaatcagcatccggagcaaagtttccaagatggtggtagtgattgtgcttctctttgccatctgctgggggcccatccagatctttgtcctcttccagtctttctatcctaactaccagcctaactacgccacatacaagatcaagacgtgggccaactgcatgtcctacgccaactcctctgtcaaccccatagtttatggcttcatgggagctagtttccaaaagtctttcaggaaaacttttcccttcctgttcaagcacaaggtcagagacagcagcatggcttcaaggactgccaatgctgagattaagtttgttgctgcggaggaaggcaacaataataacgcggtgaactgatcccgatcatttaacataagaaggatagggacagttttctaatgagaatcctgaaaaaaaaaaaaaaa

SEQ ID NO: 202 - DNA, 59 bp, Unknown
  Description of Unknown: kiss sequence
tttcaactacaaccctctcagccttcgctttgggaaacgctacaatggctacatttaca

SEQ ID NO: 203 - DNA, 58 bp, Artificial Sequence
  Description of Artificial Sequence: Synthetic oligonucleotide
  modified_base (36)..(44): a, c, t, g, unknown or other
tttcaactacaaccctctcagccttcgctttgggannnnnnnnnaacgctacaatggc

SEQ ID NO: 204 - DNA, 59 bp, Artificial Sequence
  Description of Artificial Sequence: Synthetic oligonucleotide
  modified_base (36)..(39): a, c, t, g, unknown or other
tttcaactacaaccctctcagccttcgctttgggannnnaacgctacaatggctacatt

SEQ ID NO: 205 - DNA, 55 bp, Artificial Sequence
  Description of Artificial Sequence: Synthetic oligonucleotide
  modified_base (30)..(32): a, c, t, g, unknown or other
tttcaactacaaccctctcagccttcgctnnnacgctacaatggctacatttaca

SEQ ID NO: 206 - DNA, 48 bp, Artificial Sequence
  Description of Artificial Sequence: Synthetic oligonucleotide
tttcaactacaaccctctcagcctaacgctacaatggctacatttaca

SEQ ID NO: 207 - DNA, 47 bp, Artificial Sequence
  Description of Artificial Sequence: Synthetic oligonucleotide
tttcaactacaaccctctcagcctacgctacaatggctacatttaca

SEQ ID NO: 208 - DNA, 47 bp, Artificial Sequence
  Description of Artificial Sequence: Synthetic oligonucleotide
tttcaactacaaccctctcagccttcgctacaatggctacatttaca

SEQ ID NO: 209 - DNA, 47 bp, Artificial Sequence
  Description of Artificial Sequence: Synthetic oligonucleotide
tttcaactacgaccctctcagccttcgctacaatggctacatttaca

SEQ ID NO: 210 - DNA, 47 bp, Artificial Sequence
  Description of Artificial Sequence: Synthetic oligonucleotide
tttcaactacaaccctctcagccttcgctgcaatggctacatttaca

SEQ ID NO: 211 - DNA, 43 bp, Artificial Sequence
  Description of Artificial Sequence: Synthetic oligonucleotide
tttcaactacaaccctctcaacgctacaatggctacatttaca

SEQ ID NO: 212 - DNA, 64 bp, Unknown
  Description of Unknown: kiss sequence
gacagtctaccccctgaaatctcttcggcaccgaacccccaaagtagccatgattgtcagcatt

SEQ ID NO: 213 - DNA, 61 bp, Artificial Sequence
  Description of Artificial Sequence: Synthetic oligonucleotide
  modified_base (31)..(33): a, c, t, g, unknown or other
gacagtctaccccctgaaatctcttcggcannnccccaaagtagccatgattgtcagcatt

SEQ ID NO: 214 - DNA, 59 bp, Artificial Sequence
  Description of Artificial Sequence: Synthetic oligonucleotide
gacagtctaccccctgaaatctcttcggcacccccaaagtagccatgattgtcagcatt

SEQ ID NO: 215 - DNA, 57 bp, Artificial Sequence
  Description of Artificial Sequence: Synthetic oligonucleotide
gacagtctaccccctgaaatctcttcggcccccaaagtagccatgattgtcagcatt

SEQ ID NO: 216 - DNA, 54 bp, Artificial Sequence
  Description of Artificial Sequence: Synthetic oligonucleotide
gacagtctaccccctgaaatctcttcccccaaagtagccatgattgtcagcatt

SEQ ID NO: 217 - DNA, 50 bp, Artificial Sequence
  Description of Artificial Sequence: Synthetic oligonucleotide
  modified_base (21)..(24): a, c, t, g, unknown or other
gacagtctaccccctgaaatnnnnccaaagtagccatgattgtcagcatt

SEQ ID NO: 218 - DNA, 38 bp, Artificial Sequence
  Description of Artificial Sequence: Synthetic oligonucleotide
gacagtctacccccaaagtacccatgattgtcagcatt

SEQ ID NO: 219 - DNA, 45 bp, Unknown
  Description of Unknown: kiss sequence
ggcaccgaacccccaaagtagccatgattgtcagcatttgcattt

SEQ ID NO: 220 - DNA, 45 bp, Artificial Sequence
  Description of Artificial Sequence: Synthetic oligonucleotide
ggcacccaaagtagccatgattgtcagcatttgcatttggatcgg

SEQ ID NO: 221 - DNA, 51 bp, Oreochromis niloticus
ggcaccgaacccccaaagtagccatgattgtcagcatttgcatttggatcg

SEQ ID NO: 222 - DNA, 48 bp, Unknown
  Description of Unknown: kiss sequence
ggcacccccaaagtagccatgattgtcagcatttgcatttggatcggt

SEQ ID NO: 223 - DNA, 51 bp, Artificial Sequence
  Description of Artificial Sequence: Synthetic oligonucleotide
  modified_base (10)..(10): a, c, t, g, unknown or other
  modified_base (23)..(23): a, c, t, g, unknown or other
ggcacccccncagtaaccatganttgattgatttcatttggattcggatcg

SEQ ID NO: 224 - DNA, 59 bp, Oreochromis niloticus; identical to SEQ ID NO: 202

SEQ ID NO: 225 - DNA, 47 bp, Artificial Sequence; identical to SEQ ID NO: 208
  Description of Artificial Sequence: Synthetic oligonucleotide

SEQ ID NO: 226 - DNA, 41 bp, Artificial Sequence
  Description of Artificial Sequence: Synthetic oligonucleotide
tttcaactacaaccctctcagctacaatggctacatttaca

SEQ ID NO: 227 - DNA, 64 bp, Oreochromis niloticus; identical to SEQ ID NO: 212

SEQ ID NO: 228 - DNA, 61 bp, Artificial Sequence
  Description of Artificial Sequence: Synthetic oligonucleotide
gacagtctaccccctgaaatctcttcggcaaacccccaaagtagccatgattgtcagcatt

SEQ ID NO: 229 - DNA, 59 bp, Artificial Sequence; identical to SEQ ID NO: 214
  Description of Artificial Sequence: Synthetic oligonucleotide

SEQ ID NO: 230 - DNA, 57 bp, Artificial Sequence
  Description of Artificial Sequence: Synthetic oligonucleotide
gacagtctaccccctgaaatctcttcggcacccaaagtagccatgattgtcagcatt

SEQ ID NO: 231 - DNA, 56 bp, Artificial Sequence
  Description of Artificial Sequence: Synthetic oligonucleotide
gacagtctaccccctgaaatctcttcggcaccaaagtagccatgattgtcagcatt

SEQ ID NO: 232 - DNA, 55 bp, Artificial Sequence
  Description of Artificial Sequence: Synthetic oligonucleotide
gacagtctaccccctgaaatctcttcggcacaaagtagccatgattgtcagcatt

SEQ ID NO: 233 - DNA, 53 bp, Artificial Sequence
  Description of Artificial Sequence: Synthetic oligonucleotide
gacagtctaccccctgaaatctcttcggcaaagtacccatgattgtcagcatt

SEQ ID NO: 234 - DNA, 74 bp, Unknown
  Description of Unknown: kiss sequence
agaagtaatttcaactacaaccctctcagccttcgctttgggaaacgctacaatggctacatttacagaagagc

SEQ ID NO: 235 - protein, 25 aa, Unknown
  Description of Unknown: kiss sequence
RSNFNYNPLSLRFGKRYNGYIYRRA

SEQ ID NO: 236 - protein, 19 aa, Artificial Sequence
  Description of Artificial Sequence: Synthetic peptide
RSNFNYNPLSYNGYIYRRA

SEQ ID NO: 237 - DNA, 63 bp, Unknown
  Description of Unknown: kiss sequence
acagtctaccccctgaaatctcttcggcaccgaacccccaaagtagccatgattgtcagcatt

SEQ ID NO: 238 - protein, 25 aa, Artificial Sequence
  Description of Artificial Sequence: Synthetic peptide
RSNFNYNPLSLRFGKRYNGYIYRRA

SEQ ID NO: 239 - protein, 12 aa, Artificial Sequence
  Description of Artificial Sequence: Synthetic peptide
TVYPLKSLRPPK

SEQ ID NO: 240 - DNA, 17 bp, Artificial Sequence
  Description of Artificial Sequence: Synthetic oligonucleotide
gagatagttttcttggt

SEQ ID NO: 241 - DNA, 90 bp, Sus scrofa
tgccgagacgggaaatgcatctcctacaagtggatttgtgatgggaacaccgagtgcaaggacgggtccgatgagtccctggagacgtgc

SEQ ID NO: 242 - DNA, 46 bp, Artificial Sequence
  Description of Artificial Sequence: Synthetic oligonucleotide
cctacaagtggatttgtgggatccacaccgagtgcaaggacgggtc

SEQ ID NO: 243 - DNA, 60 bp, Artificial Sequence
  Description of Artificial Sequence: Synthetic oligonucleotide
tgcacctcctacaagtggatttgtgggatccacaccgagtgcaaggacgggtccgctgag

SEQ ID NO: 244 - DNA, 90 bp, Artificial Sequence
  Description of Artificial Sequence: Synthetic oligonucleotide
tgccgagacgggaaatgcatctcctacaagtggatttgtgggatccacaccgagtgcaaggacgggtccgatgagtccctggagacgtgc

SEQ ID NO: 245 - DNA, 89 bp, Artificial Sequence
  Description of Artificial Sequence: Synthetic oligonucleotide
ccgagacgggaaatgcacctcctacaagtggatttgtgatggatccgaacaccgagtgcaaggacgggtccgctgagtccctggagacg

SEQ ID NO: 246 - DNA, 86 bp, Artificial Sequence
  Description of Artificial Sequence: Synthetic oligonucleotide
tgccgagacgggaaatgcacctcctacaagtggatttgggatccaccgagtgcaaggacgggtccgctgagtccctggagacgtgc

SEQ ID NO: 247 - DNA, 23 bp, Artificial Sequence
  Description of Artificial Sequence: Synthetic oligonucleotide
gctcaccaacggtctcctctcgg

SEQ ID NO: 248 - DNA, 23 bp, Artificial Sequence
  Description of Artificial Sequence: Synthetic oligonucleotide
gtcccccgagaggagaccgttgg

SEQ ID NO: 249 - DNA, 92 bp, Sus scrofa
gggcctctgggctcaccaacggtctcctctcgggggacgaagacttctcctccattgcggacatggacttctcagcccttctgagtcagatc

SEQ ID NO: 250 - DNA, 92 bp, Artificial Sequence
  Description of Artificial Sequence: Synthetic oligonucleotide
gggcctctgggctcaccaacggtctcctcccgggggacgaagacttctcctccattgcggacatggacttctcagcccttctgagtcagatc

SEQ ID NO: 251 - DNA, 15 bp, Artificial Sequence
  Description of Artificial Sequence: Synthetic oligonucleotide
ctcctccattgcgga

SEQ ID NO: 252 - DNA, 15 bp, Artificial Sequence
  Description of Artificial Sequence: Synthetic oligonucleotide
cttctgagtcagatc

SEQ ID NO: 253 - DNA, 18 bp, Artificial Sequence
  Description of Artificial Sequence: Synthetic oligonucleotide
ggaagaagtatcagccat

SEQ ID NO: 254 - DNA, 16 bp, Artificial Sequence
  Description of Artificial Sequence: Synthetic oligonucleotide
acagaaattctgggtc

SEQ ID NO: 255 - DNA, 23 bp, Artificial Sequence
  Description of Artificial Sequence: Synthetic oligonucleotide
gaatttctgtcttcctgggaggg

SEQ ID NO: 256 - DNA, 86 bp, Sus scrofa; identical to SEQ ID NO: 156

SEQ ID NO: 257 - DNA, 90 bp, Artificial Sequence; identical to SEQ ID NO: 158
  Description of Artificial Sequence: Synthetic oligonucleotide

SEQ ID NO: 258 - DNA, 58 bp, Artificial Sequence
  Description of Artificial Sequence: Synthetic oligonucleotide
aaggccaattactgctctggagaatatgaattcgtatttttgcaaaagtatcctcata

SEQ ID NO: 259 - DNA, 14 bp, Artificial Sequence
  Description of Artificial Sequence: Synthetic oligonucleotide
gctctggagaatgt

SEQ ID NO: 260 - DNA, 58 bp, Bos taurus
aaggccaattactgctctggagaatgtgaatttgtatttttgcaaaagtatcctcata

SEQ ID NO: 261 - DNA, 14 bp, Artificial Sequence
  Description of Artificial Sequence: Synthetic oligonucleotide
gctctggagaatat

SEQ ID NO: 262 - DNA, 14 bp, Artificial Sequence
  Description of Artificial Sequence: Synthetic oligonucleotide
aaaagtatcctcat

SEQ ID NO: 263 - DNA, 53 bp, Sus scrofa
tccgtcctttgccaaccttggccgaccagcccttagcaaccgtgggcccccaa

SEQ ID NO: 264 - DNA, 18 bp, Artificial Sequence
  Description of Artificial Sequence: Synthetic oligonucleotide
ccgtcctttgccaacctt

SEQ ID NO: 265 - DNA, 19 bp, Artificial Sequence
  Description of Artificial Sequence: Synthetic oligonucleotide
agcaaccgtgggcccccaa

SEQ ID NO: 266 - DNA, 53 bp, Artificial Sequence
  Description of Artificial Sequence: Synthetic oligonucleotide
tccgtcctttgccgacttcggccgaccagcccttagcaaccgtgggcccccaa

SEQ ID NO: 267 - DNA, 22 bp, Capra hircus
gctgagagcgcaggaatccagg

SEQ ID NO: 268 - DNA, 22 bp, Capra hircus
cctggattcctgcgctctcagc

SEQ ID NO: 269 - DNA, 21 bp, Capra hircus
gctgggaccacctgtcagatc

SEQ ID NO: 270 - DNA, 21 bp, Capra hircus
gatctgacaggtggtcccagc

SEQ ID NO: 271 - DNA, 58 bp, Capra hircus
gctgagagcgcaggaatccaggcgcaggggcccgagggctgggaccacctgtcagatc

SEQ ID NO: 272 - DNA, 30 bp, Artificial Sequence
  Description of Artificial Sequence: Synthetic oligonucleotide
gctgagagcgctggggccacctgtcaggtc

SEQ ID NO: 273 - DNA, 50 bp, Artificial Sequence
  Description of Artificial Sequence: Synthetic oligonucleotide
gctgagagcgcaggaatccaggcgcgagggctggggccacctgtcagatc

SEQ ID NO: 274 - DNA, 39 bp, Artificial Sequence
  Description of Artificial Sequence: Synthetic oligonucleotide
gctgagagcgcaggaatcctgcgggccacctgtcagatc

SEQ ID NO: 275 - DNA, 32 bp, Artificial Sequence
  Description of Artificial Sequence: Synthetic oligonucleotide
gctgaccgagggctggggccacctgtcagatc

SEQ ID NO: 276 - DNA, 55 bp, Artificial Sequence
  Description of Artificial Sequence: Synthetic oligonucleotide
gctgagagcgcaggaatccaggcgcagggcgagggctggggccacctgtcagatc

SEQ ID NO: 277 - DNA, 59 bp, Artificial Sequence
  Description of Artificial Sequence: Synthetic oligonucleotide
gctgagagcgctggaatccaggcgcaggggccccgagggctggggccaccagtcagatc

SEQ ID NO: 278 - DNA, 61 bp, Artificial Sequence
  Description of Artificial Sequence: Synthetic oligonucleotide
gctgagagcgcaggaatccaggcgcagggggggcccgagggctggggccacctgtcagatc

SEQ ID NO: 279 - DNA, 55 bp, Artificial Sequence; identical to SEQ ID NO: 276
  Description of Artificial Sequence: Synthetic oligonucleotide

SEQ ID NO: 280 - DNA, 55 bp, Artificial Sequence
  Description of Artificial Sequence: Synthetic oligonucleotide
gctgagagcgcaggaatccaggcgcgatccgagggctggggccacctgtcagatc

SEQ ID NO: 281 - DNA, 50 bp, Artificial Sequence
  Description of Artificial Sequence: Synthetic oligonucleotide
gctgagagcgcaggaatccaggcgcgagggctggggccacccgtcagatc

SEQ ID NO: 282 - DNA, 55 bp, Artificial Sequence; identical to SEQ ID NO: 280
  Description of Artificial Sequence: Synthetic oligonucleotide

SEQ ID NO: 283 - DNA, 45 bp, Artificial Sequence
  Description of Artificial Sequence: Synthetic oligonucleotide
gctgagagcgcaggaatccaggcgcagggggccacctgtcagatc

SEQ ID NO: 284 - DNA, 30 bp, Artificial Sequence
  Description of Artificial Sequence: Synthetic oligonucleotide
gctgagagcgctggggccacctgtcagatc

SEQ ID NO: 285 - DNA, 55 bp, Artificial Sequence
  Description of Artificial Sequence: Synthetic oligonucleotide
gctgagagcgcaggaatccacgcgcagggcgagggctggggccacctgtcagatc

SEQ ID NO: 286-293 - skipped (8 entries)

SEQ ID NO: 294 - DNA, 58 bp, Capra hircus; identical to SEQ ID NO: 271

SEQ ID NO: 295 - DNA, 58 bp, Artificial Sequence
  Description of Artificial Sequence: Synthetic oligonucleotide
gctgagagcgcaggaatccaggcgcaggggcccgagggctggggccacctgtcagatc

SEQ ID NO: 296 - DNA, 58 bp, Artificial Sequence
  Description of Artificial Sequence: Synthetic oligonucleotide
gctgagagcgcaggaatccgggcgcaggggcccgagggctgggaccacctgtcagatc

SEQ ID NO: 297 - DNA, 58 bp, Artificial Sequence; identical to SEQ ID NO: 295
  Description of Artificial Sequence: Synthetic oligonucleotide

SEQ ID NO: 298 - DNA, 58 bp, Artificial Sequence; identical to SEQ ID NO: 271
  Description of Artificial Sequence: Synthetic oligonucleotide

SEQ ID NO: 299 - DNA, 58 bp, Artificial Sequence; identical to SEQ ID NO: 295
  Description of Artificial Sequence: Synthetic oligonucleotide

SEQ ID NO: 300 - DNA, 62 bp, Artificial Sequence
  Description of Artificial Sequence: Synthetic oligonucleotide
gctgagagcgcaggaatccaggcgcaggggcgggcccgagggctggggccacctgtcagatc

SEQ ID NO: 301 - DNA, 48 bp, Bos taurus
tggcaggtaaggcggccaacgggggagctgcccagcgcaccgtgagct

SEQ ID NO: 302 - DNA, 48 bp, Bos taurus
agctcacggtgcgctgggcagctcccccgttggccgccttacctgcca

SEQ ID NO: 303-310 - skipped (8 entries)

SEQ ID NO: 311 - DNA, 47 bp, Artificial Sequence
  Description of Artificial Sequence: Synthetic oligonucleotide
gcaggtaagaaggccaacggaagctttgcccagcgcaccgtgagcta

SEQ ID NO: 312 - DNA, 44 bp, Artificial Sequence
  Description of Artificial Sequence: Synthetic oligonucleotide
gcaggttaggcagccaaccgagctgtacaccgccccctgagctt

SEQ ID NO: 313 - DNA, 42 bp, Artificial Sequence
  Description of Artificial Sequence: Synthetic oligonucleotide
gcaggtaaggcggccaacgctaccccacccacccggggctta

SEQ ID NO: 314 - DNA, 44 bp, Artificial Sequence
  Description of Artificial Sequence: Synthetic oligonucleotide
gcaggtaaggcggccaacgggacttcccattggaccgtgagcta

SEQ ID NO: 315 - DNA, 45 bp, Artificial Sequence
  Description of Artificial Sequence: Synthetic oligonucleotide
gcaggtaaggcggccaacggggtctgcccagcacaacgggagcta

SEQ ID NO: 316 - DNA, 43 bp, Artificial Sequence
  Description of Artificial Sequence: Synthetic oligonucleotide
gcaggtaaggcggccaacctgctccccacaccacgagctacta

SEQ ID NO: 317 - DNA, 43 bp, Artificial Sequence
  Description of Artificial Sequence: Synthetic oligonucleotide
gcaggtaaggcggccaacgaggtgcccccgggagctaccccta

SEQ ID NO: 318 - DNA, 42 bp, Artificial Sequence
  Description of Artificial Sequence: Synthetic oligonucleotide
gcaggtaaggcggccaactgccgcccacaccaccagctaccc

SEQ ID NO: 319 - DNA, 35 bp, Artificial Sequence
  Description of Artificial Sequence: Synthetic oligonucleotide
gcaggtaaggcggccgcccagctgcccgtgagcta

SEQ ID NO: 320 - DNA, 148 bp, Artificial Sequence
  Description of Artificial Sequence: Synthetic polynucleotide
ttttatatacattttacacacatatatatgaaacataacttcgtataggagactttatacgaagttatggatccaagcttataacttcgtataatgtatgctatacgaagttattgacagtattaatggcctgaacctagccagaact

SEQ ID NO: 321 - DNA, 57 bp, Artificial Sequence
  Description of Artificial Sequence: Synthetic oligonucleotide
  modified_base (9)..(18): a, c, t, g, unknown or other
gcaggtaannnnnnnnnngggggacaggttacaaggaacccatggcaccgtgagcta

SEQ ID NO: 322 - DNA, 34 bp, Artificial Sequence
  Description of Artificial Sequence: Synthetic oligonucleotide
caggtaagaaggccaacggaagctttgcccagcg

SEQ ID NO: 323 - DNA, 34 bp, Artificial Sequence; identical to SEQ ID NO: 322
  Description of Artificial Sequence: Synthetic oligonucleotide

SEQ ID NO: 324 - DNA, 34 bp, Artificial Sequence; identical to SEQ ID NO: 322
  Description of Artificial Sequence: Synthetic oligonucleotide

SEQ ID NO: 325 - DNA, 34 bp, Artificial Sequence; identical to SEQ ID NO: 322
  Description of Artificial Sequence: Synthetic oligonucleotide

SEQ ID NO: 326 - DNA, 34 bp, Artificial Sequence; identical to SEQ ID NO: 322
  Description of Artificial Sequence: Synthetic oligonucleotide

SEQ ID NO: 327 - DNA, 34 bp, Artificial Sequence; identical to SEQ ID NO: 322
  Description of Artificial Sequence: Synthetic oligonucleotide

SEQ ID NO: 328 - DNA, 25 bp, Artificial Sequence
  Description of Artificial Sequence: Synthetic oligonucleotide
caaagttggtgacgtgacagaggtc

SEQ ID NO: 329 - DNA, 24 bp, Artificial Sequence
  Description of Artificial Sequence: Synthetic oligonucleotide
gtgtgccatccctactttgtggaa

SEQ ID NO: 330 - DNA, 22 bp, Artificial Sequence
  Description of Artificial Sequence: Synthetic primer
gatgtattcctcagacttttcc

SEQ ID NO: 331 - DNA, 20 bp, Artificial Sequence
  Description of Artificial Sequence: Synthetic primer
gtggaatctcatcttaccaa

SEQ ID NO: 332 - DNA, 24 bp, Artificial Sequence
  Description of Artificial Sequence: Synthetic oligonucleotide
gggcaagttgctcagctgtttttg

SEQ ID NO: 333 - DNA, 23 bp, Artificial Sequence
  Description of Artificial Sequence: Synthetic oligonucleotide
tccgcatggtttagcaggattca

SEQ ID NO: 334 - DNA, 24 bp, Artificial Sequence
  Description of Artificial Sequence: Synthetic primer
atcgaacctgggtcttctgcattg

SEQ ID NO: 335 - DNA, 23 bp, Artificial Sequence
  Description of Artificial Sequence: Synthetic primer
tccgcatggtttagcaggattca

SEQ ID NO: 336 - DNA, 25 bp, Artificial Sequence
  Description of Artificial Sequence: Synthetic primer
ccttgaggtaggagagtgttttggg

SEQ ID NO: 337 - DNA, 25 bp, Artificial Sequence
  Description of Artificial Sequence: Synthetic primer
ttcaccagaagacaaggagaattgc

SEQ ID NO: 338 - DNA, 27 bp, Artificial Sequence
  Description of Artificial Sequence: Synthetic primer
taaggccaattactgctctggagacta

SEQ ID NO: 339 - DNA, 28 bp, Artificial Sequence
  Description of Artificial Sequence: Synthetic primer
cctttttagaagtcaaggtaacagacac

SEQ ID NO: 340 - DNA, 25 bp, Artificial Sequence
  Description of Artificial Sequence: Synthetic primer
ttgattggagacatctttgtgggag

SEQ ID NO: 341 - DNA, 27 bp, Artificial Sequence
  Description of Artificial Sequence: Synthetic primer
taaggccaattactgctctggagatta

SEQ ID NO: 342 - DNA, 24 bp, Artificial Sequence
  Description of Artificial Sequence: Synthetic primer
gcatcgagattctgtcacaatcaa

SEQ ID NO: 343 - DNA, 25 bp, Artificial Sequence
  Description of Artificial Sequence: Synthetic primer
acgtactcttcatttcacagcctac

SEQ ID NO: 344 - DNA, 25 bp, Artificial Sequence
  Description of Artificial Sequence: Synthetic primer
gtctggggtgagatagttttcttgg

SEQ ID NO: 345 - DNA, 24 bp, Artificial Sequence
  Description of Artificial Sequence: Synthetic primer
ggcagagatgttggtcttgggtgt

SEQ ID NO: 346 - DNA, 46 bp, Artificial Sequence
  Description of Artificial Sequence: Synthetic oligonucleotide
ctcctccattgcggacatggacttctcagcccttctgagtcagatc

SEQ ID NO: 347 - DNA, 22 bp, Artificial Sequence
  Description of Artificial Sequence: Synthetic oligonucleotide
tttagatcaaaactctcttttc

SEQ ID NO: 348 - DNA, 15 bp, Artificial Sequence
  Description of Artificial Sequence: Synthetic oligonucleotide
agttttcttggtagg

SEQ ID NO: 349 - DNA, 8660 bp, Sus scrofa
aagcttatgcctttgcagcctcaattttccttcgtactgttttcaattcagttttgtaatataccaaataattttctttactttgtttttattttgttttgtttttggctgccctgagatgtatggagttcctgggccagggatcagatctaagccacagttttgacctacctcagctgcagcaacaccagattcttaacccattctgctgggctggggattgaacctgtgtgccagtactaccaagacgcctccaattccattgtgccacagtgggaactcctcttttctttgttaacatgcaccaaagttctaatattttgttcccatagctcaatggatccatacttttttttcaatattttattttatttttttcttttgattgcctcacctacggcctatggaaggaagttcttgagtttggggtggaatcagagctgcagctgccagcctacatcacagccatggcagcaccgaatccgagctgcatctgtgaactatgtcacagcttgtggccatgctggatctttaagccactgagggaggccagggatcaaacccacatcctcacagaaacaacatttggtccttaacccactgagtcacaagggaactctctggatccatactctagactcagcatccaaccatgatgtcaaaatctcacattgttgacaaatctcttttgggtatactctttgcatcctccatgaggtagatctatctcattgatgatatatataaaatatatatgatatgtatatatttatataaaaattatatatttatgtataatttttttccatgatatgtgtgtgtgtgtataatttttttcctttctctttggtcatgcctgtggcatgtggaagatcctggggccagggatcaaacccgagccacagccgtaataatgccagctccttaacctgctacatcatcaaggaactcaatcctccacgatgttgttggttcttgaaattgaatttgttcatatttcatttcctgggaacctgactgttacgataggattgtatttctggctcatttctcagctggcaagaaatagacacagggagtatggtcacttgctgatcctggcactgatgcttcatttccttttccttctctctcagtggaagagaaatgtgggagaaacgagttccagtgccgagacgggaaatgcatctcctacaagtggatttgtgatgggaacaccgagtgcaaggacgggtccgatgagtccctggagacgtgcagtgagtccccttgggttgtgacctttctgaccatggtgggtgatagactcggtgggaatcagcttgtgtattgatgcattctgctgtgaattaggatgtgggcggagaaggtatttctggaactttcctttaatggccctcccgttttttttttaatgagatgaaaataggatttttttttttttttttttttttggtatttttacctcatatggaggttcccaggctaggggtctaaccggagctgtagccagatctgagcttcgtctgtgacctataccacagctcatggcaacgctggacccttaacccactgagcaaggccagggatcgaacctgggtcctcatggatgcttgttgggttcgttttccactgagccacaactggaactcctagattcttttctagtatagttattacaagatattgaatatagtttcctgtgctatgcagtaggtccttgtcgtctatctatttaatatgtagtgtcgtgtatctgttaattccaaactcctaatttatccctatagcccttaccaactggtcacttaatttttttccaatttaatataatttttattttattttagtctttttgccttttcttgagtgctcctgtggcatatggaggttcccaggctaggggtctaatcggagctgtagccactggcctacgccagagccacagcaaggcaggatctgagccgtgtctgtgacctacaccacaactcacagcaacaccagatccttaacccactgagcaaggccagggatcgaacccgcaacctcatggttcctagtcagattcgttaaccattggagcccacccatgggaactcctataatttttattttattaaataaaatgtaaaggggagctcgctactcacttttgggctgctcccacagcatgcagaagttccccaggccagcgatggaaccctagcccacagcagtgacaatgccagatccttaaccattaggccaccagggaactccaaggttttttcctttgcaaagcccagactggcaaggcaggttggtcttcctatgagttaagggtcaatgctgttttctcccacagtgtctgtcacctgcaagataggggactttagctgtgggggccgtgtcaaccgctgcattcctgagtcttggaggtgtgacggtcagcaggactgcgagaatggctcagatgaggaaggctgttgtaagtggggtccctcacctcatgggccatgggcctcagccacgtccaagtgacccgaccagattctggtctgaggtcagaatttgttcctccagctgagagttccacaaagaaacaaggctgatagtttcagatgggaaggcatgtggcagctggctctttgattttattcattatttataatttccttttcagctatataaacttttttttttttttttttttttttttggccgcatctatggcatgtggaaattcctgggccagggatcaaacctgtgccacagcagtgacaaccctggatcattaacccactgagccactggggaactcttgtatagacatgtctttcatgaagtgaggctctttaaaaaaacaaaaacctctggacaggttgtaataacctataatgggagagaatgtaaaaggaagagaaatatatatatttctctctctcttttttttatttggtcgcatccactgcatatcaagttcccaggccagggactgaattcaaggtgcagctgcaacccactgcacagcagtgacaactgccagatccttaacctgctgaacgaccagggaactccctctttttcatgttcttttccattatagtttattacaagaaattgaatgtggatccctgtgcaaactcttaaatagtgcttcccatgtgcccagcccaacctgggaactttacacacgttcctcacagtaacaccttgagacacgaacagacgtccgaggcattgagagggccgggagctgggtgggtatctgggtggggcagtggttccaaatccagggcccctgactactaccccaggtccactcactgggcttggcctgtcctgggctcagtgtccccatctatgcagtgggctggtgtagggcctccccggtaacctggctgtgatcttctgtctatttctgaagcccccaagacgtgctcccaagatgagttccgctgccaggacggcaagtgcatcgccccaaagtttgtctgtgactcggaccgggactgcctggacggctcggatgaagcatcctgccccacacccacctgtggccccgccagcttccagtgcaacagctccacctgcatccctgagctgtgggcctgtgatggtgatcctgactgcgaggacggctcagacgagtggccacagcactgcaggagccacagctcatcactccccgagaggagcaacaacccctgctcagccctcgagttccactgccacagtggcgagtgcatccactccagctggcgctgcgacggagacactgactgcaaggacaagtctgacgaggagaactgcggtaggggcgccttggggatcccttcacctgtccctgggccctcctgtgtggggggtggggggctggccagtgcctttaggtggttctgatcttggagagacagctgtgagtgatggctcgaagcaagatcttaattctctgctcgggaatcaaacctgggcagcctgggtgttccgtggtgggctcagtggttaacgaatctgactaggaaccatgagggttgcaggttcgatccctggccttgctcagtgggttaaggatctggtgttgctgtgagctgtggtgtaggttgcagacgcagctcagatctggtgttgctgtggctctggcataggccagcggctacagctccgattcaacccctagcctgggaacctccatatgccgtgagtgaggccctagaaaatacaaaaaacaaaacctgagcagcctgggtgaaaaccaggaatcttagctagaggctggaagcagaattgccttgattcttgctccctgttgaaaagcaagaatgtttcaaggagacaaagactgtaaaaacaggtacaaagtttattgtcagagacacagtgtgacatgttggagagcacacagggaagtagtttatttaggagttcccatcatagctcagtggttaacgaacccacctagcatccatgaggacacaggttcgatccttggcctcgctcagtgggttaaggatccggcattgccgtgagctgtggtgtaggtcacaggctaggattggatctcgagtggctgtggctgtggtgtcggccagcagctacagtcccccagtttgacccctagcctgggaacttccacatgctgtgcgtgtggccctaaaaagactgaaaaaagaaaaagtagtttatttaagtcagagcaaagcagtaatccacacccaaaagaggagtgctggcgttccccccccgaatgaagagcgagccagagaggtgatttaaaccactttatagacgggtctactgggtctttgtttttctttgaccagttatcctgttttatttctcacacctgaccagacccagggccctccctgatctgtgtgtgcagcttttggtcaagatggatttcagagcaaagtgttatgggagggcatcaggacctactatggcctggtaccccacctccgtttttgacccccaagagtttctctgtgtatatataactggggaggtcttcttgacccccaggagtaattgaagtagtcagcttatctctctatactagggagttcccatcgtggctcagtggtaaggaacctgactagtatccattaggacgcaggtttgaaccctgtcctcactcagtaggttaaggatctggtgttgccgtgagttctgtaggttgcagactcagctgggacctggtgttgctgtggctgtgatctaggccggcagcggcagcagcagcagcagtagctccgattcaacccctagcctgggaacttctatatgccgagggtgctgccctaaaaagaaaaaaaaaaatctttttattccagcagagctcaggtcctgccattaactttctccttgacatgtcaaaaagaagcaaagcccaaattaccaagcctgacgtgtcccagctgttctcagcccaggggcccatctacttcctacctcagttcaatgatttcgcatcacacagcaagaaagttggccccatttcaggtttcttccaatctttctgatcacttggaggacaagctccatctcaaatgtctccttaattagtctcttttgacaaggggcacacactgcaacccgcagtgtctttttgtccagaaatcatcctgggctccgggcctggctggtgacgtccctgctgcgtgacccttggccaaggacttagcctcactgtgccgtgatcccctcccctgttatggggcaacagccttggccttctcagaccttgggcagaatccagcgccaccgatagaactttctgtgaggctgccccgtgcaccagagctgggcagtgtggctggttcaccgaagcccagaattcttaggtttatttcgctttaactaattgaaagttaaatggccacgtgtagttagtggctcctgcataggagagagtgccagtcaaggacctggccctgaatggaggccgttcacccatgactaatgatgtaggaagtttccctctttctgtttctttggtacctttgcccttgggcacagttttcagagttgcactcactgtatagttgccactatacagactttttgtttatttgttgtttttagattaacaaatcagtatgttctttttaaaaaaagtttattatagttgatttacaatgttctgtcgatttagatttttaaattttttttaatttatttttatttattttattttattttttattttttattttttttgcttttgagggccaccccctcggcatatggaggttcccaggctagggggtctagtccgagctgtagccgccagcctacgccacagccacagcaattcaggatccaagccgcgtctgtgacctacaccacagctcacagcaacactggatccctaacccactgagcaaggtcagggatcaaacccgcaacctcatggttcctagtcagattcgttaaccactgagccacaatgggaactccaaatgttactttttaagaacaattagagactttgtctgtgattggttctaaaactgaacacaaacttggttaatccccatgccttgagcaggcttccctcattctttacagatgaggaaaccaaggcacagaaaggcagagtagccttctgaggacacacacctatgaaaactatacttcccatatgtaccctactattttagctgtcgtctgagtgcatttttcattagagttaatgctcagttgtgtttttgttccttattgcaaagatgaacaaatggtttaaaaataaaatcatgggaattcccgctctggtgcagcgggttaagaatctgacagcaacagctctggtcgctgtggaggtgcaggttcgatctccagccctgtgctctggcttaaggatccagcattgctgcagctgtggcctaggttgcaactgtggcttgcattcgattcttggccctgggactttttttaatatgccacaagtgtggctattaaaaaaaaaaaaaaaaagaatcattctgggagtttccttgtgcaggtacaggggttaaggatccagcatttcactgctatggccctggttactgctgtgtcatgagttcactccctggcccccagaatttctgtatgccatagacatggcccccaaaacacaaaaacacaaaagggattcttttctatcctgtgagaaaccataatggaaataaaaaagaatatgtgtgttacagataaaaactgagtcactttacagtacagcagaaattaacacaatgttgttaatcaactatacttccttaaaattaaaaaaacacgatcattctaaatgaaaggaagcaaaacaaagcaaaaacaggatcattctatgtaacagaaattggcacaagattgttattcaactttaataaaaaaagtttattataaattggctgcacccaagacatgcacctgaggcatgtggaagtttctgcaccatagctgtaactagagtgagagcagtgacaaggccagatccttacccactgagccacccagggaactcctgagggtctgccagctttttaataaatttcctggttttttgtgttttattgtttgtgtctttttgccatttcttgggcccgctccctatggcatatggaggttcccaggctaggggtccaattggagctgtagccgccggcctaccccagaaccacagcaacgcgggatccgagccacgtctgcaacctacaccacagctcatgggcaatgctggatccttaacccactgagcaaggccagggatcaaacccgcaacctcacgcttcctagttggattcgttaaccgctgagccacgacgggaactccatgaatttcctgttttgaaacatgcatgtgaagacaaagcagagagaagtctaagaaaacttaatatttgtgtattgcccattttcttatcttccacacttggctctgcctctcccagatgtggccacgtgccggcctgacgagttccagtgctcagacgggacctgcatccatggtagccggcagtgcgacagggaatatgactgcaaggacctgagcgacgagcagggctgtgtcaatggtgagctctgttccatggggtcctgggcctgggggagatgtggggaggagcctcctgggtcctcactggctgtttgtccttggggaaattagttgacctctctgagcctcacttctgcttatctgaaaactgtgcaaaatgaaagccctacctcaggactgtgagaatgaggtcagagtgtagagagctcatatacttaccctgagttacatgcagatataactccatgtaaaaagcactttgctgaatctacaacattgcagttcctgttcttgggaatgatgccaggagaaacttagacctgtgcactggaggatagaccctggaacaggcagagcagcactgtcctaacagcaaaacattagaagcaacccaaatgtttatcagcagtagaattaatttaattaatttatttttttggcttaattttaaggccacatccacggcatatggaggttcccaggctaggggtctaattggagctgtagcagccagccttcaccagagccacagaaacaacagatccgagctgcgtctgcaacctacaccacagcttgcagcaacgccggatccttaaaccactgagcgaggctagggttcaaacccatgccctcacggaagctt

SEQ ID NO: 350 - DNA, 6164 bp, Artificial Sequence
  Description of Artificial Sequence: Synthetic polynucleotide
gccaggacggcaagtgcatcgccccaaagtttgtctgtgactcggaccgggactgcctggacggctcggatgaagcatcctgccccacacccacctgtggccccgccagcttccagtgcaacagctccacctgcatccctgagctgtgggcctgtgatggtgatcctgactgcgaggacggctcagacgagtggccacagcactgcaggagccacagctcatcactccccgagaggagcaacaacccctgctcagccctcgaggtcgacctgcagccaagctatcgaattcctgcagcccaattccgatcatattcaataacccttaatataacttcgtataatgtatgctatacgaagttattaggtctgaagaggagtttacgtccagccaagctagcaaacaggaagctgactccacatggtcacatgctcactgaagtgttgacttccctgacagctgtgcactttctaaaccggttttctcattcatttacagttcagccgatgatgaaattgccgcactggttgttagcaacgtagccggtatgtgaaagatggattcgcgggaattccgccccccccccccccccccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccacaaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgactagagcttgcggaacccttaatataacttcgtataatgtatgctatacgaagttattaggtccctcgagttccactgccacagtggcgagtgcatccactccagctggcgctgcgacggagacactgactgcaaggacaagtctgacgaggagaactgcggtaggggcgccttggggatcccttcacctgtccctgggccctcctgtgtggggggtggggggctggccagtgcctttaggtggttctgatcttggagagacagctgtgagtgatggctcgaagcaagatcttaattctctgctcgggaatcaaacctgggcagcctgggtgttccgtggtgggctcagtggttaacgaatctgactagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcctcttgtatagacatgtctttcatgaagtgaggctctttaaaaaaacaaaaacctctggacaggttgtaataacctataatgggagagaatgtaaaaggaagagaaatatatatatttctctctctcttttttttatttggtcgcatccactgcatatcaagttcccaggccagggactgaattcaaggtgcagctgcaacccactgcacagcagtgacaactgccagatccttaacctgctgaacgaccagggaactccctctttttcatgttcttttccattatagtttattacaagaaattgaatgtggatccctgtgcaaactcttaaatagtgcttcccatgtgcccagcccaacctgggaactttacacacgttcctcacagtaacaccttgagacacgaacagacgtccgaggcattgagagggccgggagctgggtgggtatctgggtggggcagtggttccaaatccagggcccctgactactaccccaggtccactcactgggcttggcctgtcctgggctcagtgtccccatctatgcagtgggctggtgtagggcctccccggtaacctggctgtgatcttctgtctatttctgaagcccccaagacgtgctcccaagatgagttccgct

SEQ ID NO: 351 - DNA, 90 bp, Artificial Sequence
  Description of Artificial Sequence: Synthetic oligonucleotide
ctaaaagatataaggccaattaccgctctggagaatatgaattcgtatttttgcaaaagtatcctcatccccatcttgtgcaccaagcaa

SEQ ID NO: 352 - DNA, 90 bp, Artificial Sequence
  Description of Artificial Sequence: Synthetic oligonucleotide
ctaaaagatataaggccaattactgctctggagaatatgaattcgtatttttgcaaaagtatcctcatacccatcttgtgcaccaagcaa

SEQ ID NO: 353 - DNA, 90 bp, Artificial Sequence
  Description of Artificial Sequence: Synthetic oligonucleotide
ctaaaagatataaggccaattactgctctggagaatatgaatttgtatttttgcaaaagtatcctcatacccatcttgtgcaccaagcaa

SEQ ID NO: 354 - DNA, 50 bp, Artificial Sequence
  Description of Artificial Sequence: Synthetic oligonucleotide
ctcctacaagtggatttgtgatgggaacaccgagtgcaaggacgggtccg

SEQ ID NO: 355 - DNA, 58 bp, Artificial Sequence
  Description of Artificial Sequence: Synthetic oligonucleotide
gtgatgaacactccacagaatctcgatgctgtcgttaccctctaactgtggattttga

SEQ ID NO: 356 - DNA, 50 bp, Artificial Sequence
  Description of Artificial Sequence: Synthetic oligonucleotide
ggatgaaaccgaaattagaagtttctttgctagatatggttcagtaaaag

SEQ ID NO: 357 - DNA, 51 bp, Artificial Sequence
  Description of Artificial Sequence: Synthetic oligonucleotide
ggaagaagtatcagccattcatccctcccaggaagacagaaattctgggtc

SEQ ID NO: 358 - DNA, 48 bp, Artificial Sequence
  Description of Artificial Sequence: Synthetic oligonucleotide
ggcacccgtgtccgcgccatggccatctacaagaagtcagagtacatg

SEQ ID NO: 359 - DNA, 48 bp, Artificial Sequence
  Description of Artificial Sequence: Synthetic oligonucleotide
gctctactctaccccctaccagcctgggtgctgggcgacttcatgtgc

SEQ ID NO: 360 - DNA, 51 bp, Artificial Sequence
  Description of Artificial Sequence: Synthetic oligonucleotide
ccgtcctttgccaaccttggccgaccagcccttagcaaccgtgggccccca

SEQ ID NO: 361 - DNA, 51 bp, Artificial Sequence
  Description of Artificial Sequence: Synthetic oligonucleotide
ctgcgctccttcaaagtgtttaagatcaagcctgagaagaggtggcaggac

SEQ ID NO: 362 - DNA, 51 bp, Artificial Sequence
  Description of Artificial Sequence: Synthetic oligonucleotide
accttcctcctctccgctacccagccacttgcacattcaaaagcagcttag

SEQ ID NO: 363 - DNA, 52 bp, Artificial Sequence
  Description of Artificial Sequence: Synthetic oligonucleotide
cccaaaggttcagtgttttgtgttcaatgttgagtacatgaattgcacttgg

SEQ ID NO: 364 - DNA, 44 bp, Artificial Sequence
  Description of Artificial Sequence: Synthetic oligonucleotide
gctctggagaatatgaatttgtatttttgcaaaagtatcctcat

SEQ ID NO: 365 - DNA, 44 bp, Artificial Sequence
  Description of Artificial Sequence: Synthetic oligonucleotide
gctctggagaatgtgaatttgtatttttgcaaaagtatcctcat

SEQ ID NO: 366 - DNA, 47 bp, Artificial Sequence
  Description of Artificial Sequence: Synthetic oligonucleotide
actgctctggagagtgtgaatttgtatttttacaaaaataccctcac

SEQ ID NO: 367 - DNA, 48 bp, Artificial Sequence
  Description of Artificial Sequence: Synthetic oligonucleotide
ctcgcattgcccactgggtgggtgcttaggtaggtagggtggagagag

SEQ ID NO: 368 - DNA, 52 bp, Artificial Sequence
  Description of Artificial Sequence: Synthetic oligonucleotide
atacattttacacacatatatatgaaactgacagtattaatggcctgaacct

SEQ ID NO: 369 - DNA, 54 bp, Artificial Sequence
  Description of Artificial Sequence: Synthetic oligonucleotide
acagaggaggccagctggttccgagagacagaaatatatcagacggtgttgatg

SEQ ID NO: 370 - DNA, 52 bp, Artificial Sequence
  Description of Artificial Sequence: Synthetic oligonucleotide
gagagcgcaggaatccaggcgcaggggcccgagggctgggaccacctgtcag

SEQ ID NO: 371 - DNA, 49 bp, Artificial Sequence
  Description of Artificial Sequence: Synthetic oligonucleotide
tttcttggtaggctggtattcttgctctttagatcaaaactctcttttc

SEQ ID NO: 372 - DNA, 48 bp, Artificial Sequence
  Description of Artificial Sequence: Synthetic oligonucleotide
gcccccccacacagctgagcccatgctgatggagtaccctgaggctat

SEQ ID NO: 373 - DNA, 46 bp, Sus scrofa; identical to SEQ ID NO: 346

SEQ ID NO: 374 - DNA, 6250 bp, Sus scrofa
cccccacctcccctgggcagattgtgctccttcctcccctgtgtcctgctcatttcacactggctgtgtggtgcctcttgtctgggagggaacatcgcatatccacaccaccaccccctcctcaaataatccatttccatattgtttggggcagaatgggtctctcggtgggtctggggagaagcgggtgaggaggctggaaagaaccggtgggcatcagaaagccaggcttggaaggcttctggagggggaggaagaggctgatttcagtcctgaggacctggaggcgggagtcagccctcaagagcgggagtgctcttctctccgagggggtcagaggagcggggagggggaagcagaggggggcctttgcctggagacgtcatctggcttttataaaagggatgtgaccaaggagctggtgagagcaagcccaggagcccagctccccttcctccaagtggtctcccacccaagcagtgtcatcacctcggagacctcggggacctcgtggcgctccttctgggccaggacaaggtaggtacccacagcagaggggtctggctggacccagggaggcacccaaggagggagcaggaattcagttccaaggctgacagacgtgtcccaggcaggcagagggggtgctgctcttccctgatgtttgggttggccagactattctgggatgtctggataaatagatgaacttgtactctatgcagccaagacctggggaatcctttctgtgagagaattaagtgcagggaagaagtctctggctgggatgagaggccccagaagttttgggaaggagctggggagttcctagggctcacggggctggaaccaaagagccctgagttccccgaagcccctcacccccaccccgcactaaaagatggggtcaccccagaagggagctgccatactgcaaaagctttccaaccaggcctggaatttctgtcactcactaggtataaaacccttagggcaggggcaccacaaaaatgcccactgcagaacagccactcatggccacttggaagctgatggttcttttcccaacattttaattctaccacatgtgttaaaagcccttgtgctgggcagtgaacccagaattggtggagggtgtgtgtgtgtgtgtgtgtgtgtgtgtgtgtgtgtgtgtgtgtgtgttagggacgggtcttgggagggaaactgaagttccgacatggtgcacatggtaagtgctcctatgatgggttggggaggatggagtacaggtgagaggagtgcaaagaaggaaacttctaattgcacagtcccctgtcctcactcaccagcctgtttctgaagagcagccccagtgctccatccaagaaacgcaagtcacatattcccctccggctggctcatggctcacacagatccctgctcccggtgacaggcaggggggtgggcggcggcgtgtggccccttccccaggctcatcgctcttcctcttcagcaaagctccaccctcctggcaggctggagggcctgtgcttccccccacacccaggtccagctcccctgcggggaccactctccataaacctggtcaacttttattcatctggctgacttgtgccccaaaattcagctcaagtgccatccactgcagaacacctgcctgcacctccaggtcaggctcccatgggctctgacatccctcactccctactaccccacctcccatcccctatcccctcctaccccccaccccacccccactatcttccaaaccccacccccatcacgtactcaagagcctccagcctatcatttaccatgttattttaagatggtctcatgtgtcagtgtcctgtgctagatctcaggggagggcctgggggacgcacctgtgcctgagcacacctgtgcatctgtagcccctagcgcaacacccagttggtgctgatcaggaatgacctctgaactaacctggatcctatgcatccatggtctgaagccacaaaagaaatggttttacactcttctttccctaatggattgatcctgcctcgatgccacaccctaccccaggcctcaaggcaggtgcggaaagccatgacctgggtttcagggtatcacagagccaaagtctgcaaggataagtgaccgtctgagggagcagttggtggccagactgatcaaaactattattttctgcatggagcactaagacccagaggagggggtggtgacctgctctagtctcacagagggagagggcagagctggggccagatttgaggcctcctgatccccctcttatgctaccccatgcctgcatccaggtgggagcagagagggggacagagagttggggcaagatcagagggacagatggggctgtgtaaccattagaagctgatgggcaaaaatgatagccccacccccacttgccccttgaccacagagagaggctcgagcctttagatctggtacccacaccctttctgctcagcctgctgcgctgcttggctcgccagtggtttatctttaattatgtttgttgaaagatctcaggtgcctgatgactttttcaaagagaaatcagccttgggagctggaagagctgggggtgggatggggtgagaggaaaaggggtgtgaagggggttcagggtacacagctgccatctcaatggccaaaatcatgatgtcaattaaattcatatcctctcagagcccatggagaatagattatggagacaattgacctgatacatcagggagtttttttctttcctgaatgacaggcaataagacaatttaatgatagtcttcaaggctgttaagggttatgagagcaagcaggatgattgcctcttccttttttccaagctcagcttggacttcactgtgcaagtggtctcggtcccatttccatgctgtgtctgttcagactcatgtaattcaaaagaattaaattcctattacagcaggggttggaaactgggccaggttctggaaggcacattctaacggggagaatggagcacagaaagttgtggactgatgcagagcccagcatggagggaagacgcacctgctcccaggctccagagaaaacactgggacctcagcatcctccattcaggagacttccttgcccacttcactccacccctccctgctcactgcaggattctgagattcagaatcctggccatttcccaaccgccaggatggctgcctccttccttccctcctcccctccctcgattccttctgtccttctttccttcctaaccttactggcctctcttcctgcaggaagccctccctgacgatcctcgccaagcaagggctcagcttggactttactgtgcgagtagtctcagtcccatttccatgctattcagactcatccctccactgggggcctcctggggaaggggctgttcacctcttgtctcttggcaccgggatctgccccagcacccagcccagactcgtacctgactgaatccctcttccctttctctgtcttggcctcaggtcacttccaaaacctgcatcttctcaccaggatgaatgcactggttttttggcagctgatgttctttctttgggccacttccttcaaggagacattagaaaaagtggcacccatggagaatcctagatctacaggtatgaggtgtctggaagaagggtgggagggggcaggtgaattgtcacaaaacgaaagggaccgtatttctcagatatagctagtatgtgaatttaatgctacgtttaatggaaacctaagactggctggcacatgcaacacattttggggccccactaaccttgtaagcaagggatggcttgctgttgttatgggcaacagggggctccccgaagttcaggtgtttcttaatcaccgagccccttcatggttttctctggtctgtgccaaccatctctctgcagatctgctgggaaggaatttactatgcaagcttctttgatcagtgacctcagtttctttatggggaatttgaaaaaaaaaaaaaaagaaagaaaaaaaacctagatcaaaggacagacccttaataatttgtcaaccttatgcattcattgcggaactgatgacctggagaaaccaaggcccaaagaggcaaagaaagcttcccaaagtcgctcggtccagtgctgcaaaaactcagcagttgctgggctcctgaaatgccctctatggggcataagctaggacagggttcattccccaagtcaggagtcaaggtggtctgcttagcctccagggacctcagttcttctagctatggaactggcagccttctctctatcagatttcgaagagcaaagaggacatggccctttgccaagggagtcttctctcctgggatcaggtattctttctgggtgagggagaacaccccgggaaataaccttaccactgccctggggacactgagctcttgcctctttctggcaaaaggttttaggtgaggctaaaaacaacagcttaagcggtcatcctactgctgagatggtggctgtcgctggaaaggacaccatcgtccctcccatctcagcctgacaccaggcgaggtgggagggccctcctaggaagattatcactttgcagaccatgcccacactcctccaaagtatgccagggcatccgagagcaaggctccaagccagctacccacctgtacatgcccactcacaccccagacctcatttcccactgacctcttagaacaattggctgaggtcgttgtctcctcagagatagtcacactatttcactgccaaaaattagagttaacttaatgagccttgcatatgaagtgccttaaaattagcctcattaaccctcagtatgaaggggagagattatacccagagtgggagaggtgagctggttaaggtgacccagaaatttcttgttcttcattgaaaagttgattaggggagtcacatgtgttgggggtgtaggggcacaatggtcttagcttcactctcttgatttctgtaactgcaagcctctcattaactttcatatattgaacatttttgaggccctgctatgtgcaaagcactattttcaagactctgagaaactcagagatgaatgaacatggccccaacccccacaaggagctcaaggtctagtgggaagctggtgtgaatctggggcaggtggccagccaatgagccaagaaaagaatgtaaagctgagtgtccagtatacactttagttttatttccaagctctaccctgtttgcttcctaaaacaaagtaatttattacaaaagatacttcagataattctggaaaacataagaaatcaaagctctgtcggagttcctgtcgtggctcagtggttaacgaatctgactaggaaccatgaggtggcaggttcgatccccgacctcgctcagtgggttaaggatccggtgttgtggtgtaggtcgcagacgcggctcggatctggtgttgctgtactctggcagacactggtggctacagctcccgattagacaccccccccccccagctgggaacctccatataccgcgggtgccgccctagaaaagagacaagaaaaaagacgaccaaaaaaaaagctctgttgaaggaggaaggaacaaatggcctaaccacccaagctaagatgctggtggtgcctggcaaggaggtttgagcttcccagggacaaaaggaacaaaagggaagtagagaatggggggatgagcaaacggtccagagccgtctttcccaggtggcaggcctcacaacagcctctccttgcgactttgtcctaggcccgcggcccattccgccgccgctccaggctccctgggagcagggcccgcggtgtgcggagagaaagcccgctgccgccgaggcgaaccctcgggggacctcatcgtgccagcctcccgagagctcctcggggccccagcggccaggcctgtgcaccccccgcagccgcctgatccctgccccgcggggcgcggtgttagtgcagcgggagaaggacctgtccgcctacaactggaactccttcggcctgcgctacggaaagcggcaggcggcgccgcccgggagccgcaaccaaggcgccgggcgagactgagaccttcaaacccgggaggcgggtccaagcatgggggcggggcggggcgggggcggggaagtgggaggggcttggaatttcaacctgaaacaataaaggaaatgcagtgcgactcac

SEQ ID NO: 375 - DNA, 6853 bp, Bos taurus
cggcccatcattaaaccctggtgtttaccagccctaatgagggagataagatgtttgcaagcccctgttagcagcagctgttaaacaagggatgagtattaatccccaggatggtgggaagtgcttcccagctactgattaggtggatgtctgcacagcgcactctccaggcagcttctgtgctggggtagagggctgtgcccctagcttctaagagccccagtctgtcttgggaagcccctcatctaagggtaaagcgcactctcgcaggcccaggaaagagtcaggaatcccctgcaatgagcacatttaatacgtttctgtgagggcccctgcgtctgtgcagaaccagggagcgggtgctgaagatgcaaggaaagcagacctccccactttgaagagaggttcacggcgatttcagaatggcgaggctgtggctccacaggatgtggccgaggtgctgcaggagccgcaggtcacacaccctcacctggagagctctcctccgttccctcagcactcccagggacacctgccttctgcctttttgcgctgccttcctagctggctgctctcatgcctgtcttgcccatctgaccaccgcacgttcctctccaaaccctgagctgagctcaggaattgcttggggaaagaagggagcagagaagaaaaaagagacaatccccctaccaagtcctagaccccagcccccaacccagaagctgctgtctggtcagagaccccagctgagctgccagggctggggggtcacgggggacaagcgtgccgagcctcccccatcctcaaacagtccctttccacgttgtttgggagcagagtggatctgtgagtgggcctggggtgaggaggctgcaaagaactattaggaatcagaaagccagccctggaagactcctggagagggagcaaaaggctgattttagccacgggcaccaggaggcaggagccagcagcagggagcaggagggctgcactctccgaggggctgggggcgggcagaggtgggtctgtgcctgcagacgtcaccccgggctttataagggacatgatcagggcatcagtgagagtgagcccaggagcccagctcgcctgcctccaggtgcccccccgcccaagcggtgtcatcctttggagacccctcaggacacagccaaggcaaggtaggtggcctgcagcctccacaccaggggaggggtctggccggacccagggaggctcacgaggtgggagcaggcatgtgtccagacaggccaaaggggtgctgatcttccctgatgactgggatgtcggggtaaatacactgacttgcactttttgaaaccaggaccttgggggttactttctggggagtgactgcagtgaatgagctccccatggctgggataaggggtcccagaagcatctggaggggcctggggaacacggggggctcctctgggcagttccccgttgcgcagatggcaaacacagacataaacaaagagctcgtgagtgccctgccagccccggcactaggagatggggtcaccccagaagggagccaccccaccccaaaagctttccaagcaagcctggagtttctgttactctctaggttcaaaacccctgggacagcgggaccacaaaatcgccactgtggcccttggaagctgatggttcttttccaaacagttcagttccaccacatgttaaaagcccctgtgcgcaggacaggtaggagggaaaaaccaaagttctcacacggcgcccatggcaagcactacctctgctgggatggggaggaagcaatacaagtgagaggagcgtgaaggaggaacaccaccttctaaccacacagcttggccactgccccctccctcatgtaccaccctgcttctgaagagcagcctgaattctccatccgaaagctcatctacacacactccagtctgactcacaccgctccgagatgaagcctctggtggcccctttcccagcctcatcgctcactctctccccagccaacacccacccccccccccccaccccggcaggctggagggcggcacttccctctactcctggcgtcggcttccttgctgggactgccgtcgatgaatctttattcacctggctgacttgtgctcagaaactcagctcaggcgccacccctgcagaaaacctgcctggaccctccaggtcaggctccggtgggctctgaagcaccccgggcggcctgcagtgctgcctgctccccaccagtctatctttccattgtttgatggacaatctcaaagtgcctgatgacttttccaaagagacatcagacttgggagctggaagagccggaggagggcagtggaggataagaaggcaagggggtgaaaaggggctcagggtctccccgaccccacccacatgctcacaagcctccggtcaatcactggccatgttaccttgagacggtctgcttatgactcaatttcttgcgctagatctcaggggaaggcccggggaaggtgtgcaatacctgttgttgttaccaggaatgatttctgaactgacctggaccctgtgcatccatggcctaaagccacaacagaaatggttttacactcttctctctagtggattgaacctgtctccactccacagcctgccccaggccttacggctggtgcagaaagccatgatctgggtttcagggtatcacagagtcaaagtctacaaggaaagtggccatctgaggggacagttagtggccagtctgatccaatgctcttatttttcacaggtaacaataagatccagagattgggggtggacctgttctaatctcacaggagggagggaggagctgcagccacatttgagttcttctgataccattcttatcgtaccccgtacttgcatctcggagggagcaggaggggactggggcgcaggagcaagaacagagggatggatgggctgagctgccactggcagccgatgggtacaaacagctcccccacccacttcccccggaccgcacagggaggtccggccttagatccggcacccacacccgttccgctcagcctgcagtgctgcctgttctccacccatctgttgtgtttgctggacagtctcaaagtgcctgatgacttttccaaagagaaatcagccttgggagctggaagagccggaggggggggcagtggaggatgagaagggaagagggtgaaaagggggtcagagtctacagttcccccctcaactgccaagatcacacagtcaattaaatccataccctctcagggcccgcagagaacagaatgtggagacaatcgacctgatccatcagggaaagcctttttctctttcctgaattataggcaataagacaatttaatgatggttttcaaggctatgaagggttatgagagcaagcaagatgattacttcttccttttttcttgaaaaaggaaaaaaaaagttcctgttacagcaagaggggctgggccagatttagaaaggcacgctccagctgggagagtggagcacggagagctgtgattccggcaaagcctagcgtgcaggcaagaggcccctgctcccaggctccagggaaatggccggggcctcagcatcctccactcagtgcagctctttgcccacctcacttaacccctccctgctcatcgttacactgcatctcactcctcgtttttccaacattcctctcaagcaaacccgaagttcagaaccctggccattttccaacctgagcagtcctgccccttccacaagtatggctcctccctcccttctttccttcctaactttactggccttgcctggcaggaggccctccctgatgatcttcaccttagcatgagtttagcttgaactatatggcgcgagggctctcagtcctatttccatgctgtgttggttcaggcttgtccctccatgggcagggttgtctcctcccttccaggtgcctgctgcacgcggggctctgccccagggcctagcccaggcagcgagcctaaccccgttcctcctccctctctctgtcttggactcagggcacttccaagacctgcatcttctcaccaggatgaacgtgctgctttcctggcagctgatgcttctcctttgtgccaccgccttcagggagacactggaaaaggtggcgcccatggagaatcctagaaccacaggtatgaagttgtctgggaagaaggttgggagggagcagtgaattgatgcaaaatgagagttgccacatttttcagagatggctaatctgcggctatgaatgtaaagctgcacagtggaaacctaaggtgacacatgcaacacacacggggctccactagccttgcgagcaagagacggatttctgccgttacagacgtcaggaggctcacccaagtgcaggtgcttggtaacccccgagctccttcacgggcttctctgctcgatgccaaccgctcctctgtgcagatctgctgggcaggcatttactatgcaagtctatcttatcagtgacctcagttcctttatggggaatctgaaaaaaaaaaaaaaaaacctacacaaaaggatagatccttaatacctctcaatcttatgagttcattgtgggattgaagagctggagaaactgaggcccaaagaggtaaagaaaccttcccaaagtcactcaatccaaggctgcagaaacccagcaggtgctgagctccccccaagagggccctctacagggcgtgagctagtggtcacccccaagtcaggaatcaaggtttaatgctgctcggtggtcagcctggcctcttgggacctgtgtccctctccagcgatggaacgtgcaccattctttctacacaagatgtccttgtgcccatagatatcccaaagggggcttccctggtggctcagtggtcaagaatctgcctgccaatgcaggagacacgggtttgattcctggtttgggaaggagcaactaggcccaagcaccacaactactgagcctgtgctttagtgcccaagaaccacagctaccgaagcccgcacacttgagatgtgtgcatacttgagactccacaagagaagccactgccaagagtagcccacctaccacgactagagagtagcccctgctcgctgtaactagagaaagcccatgtgcagaagaccctgtgctgccaaaactaaaataaataaattaaaaaaaaagatgttccaatgcaaagagaccgtggacgcaggcgtcccttgccaagaacatcttctctcctgggaccgggtgctctttctgggtaagggaggatcccccggagaataatgtcatcaccgccctggggacactgagctcttggctctttttggcaaaaccttttaggtgatgctaaaaacagtgatgcctaagtagtgatccacctgctgggatgatggctgtagctggacaagaggtcctcgtccctcccatctcagccaggcccagggccctccttggaagagtatcactcaccctgggccagactcacccacgctcctctcctccagagagtgccggggcactgaagagcagggctcagagtcaactatcctcctccacccaacacacacccactcacaccccagaccgcatttccacctatccctggccacaactggctggggccattgtctcctgagagctagctgcactatcttactgctaacaatttaatgaacttaatgagccttgcatgtgaagtgccttccaagttagcctcattagccctcagtgtgaaggggagagattacacgtggagtaggggaggcgagctggttgaggtgacccagttccccttctttgctgaagccctgatatagcttattaggggtcacatttgctgagggtgtgggagcacagtggtctttgcttcgctttcttcatttgtatgactgcaagcctttcattagtttttatatatttaacaaggctttttgaggccctgctatgagcaaggcactctgaaagactcagatgagtggacatggccccaaccaccccgaggagctcggtctagtaggagcctgatgaaaagcaggggtacagggccagccagccgcgaagagaagcgaagctgattatttccaagctctatcctgcttgcttccttaaaaaaaaaaaaaaagaagaagaagaagaattcaatgtaaaagacactcaagaaaatcctgtgaaatatctgaaatcatagctatgttgaaggagagaggagcaaatggactagccacccaagctaagatgctgctggtgcccagcatggagcgctgagcttcctaggggtcaagcgacaaaagggaagccgaagatggggatgtgaggaggtggtccaaagcctttctccgggcccccgcctcactcagcatctccctgtggctctgtcctaggctcgcagcttggacccgcgacgctccgggcgccctgggagcagagcccgcggtgcgcggcggggaagcccgaggtggccgggcctcggcctcggggggccgcgctgtgcccccctgagagctccgcgggcccccagcggctgggcccgtgcgccccgcgcagccgcctgatcccgtccccgaggggcgcggtgctggtgcagcgggagaaggacgtgtccgcctacaactggaactccttcggcctgcgctacggcaggcggcaggcggcgctgcccgggagccgcagcgccgcgcggggctgagcgccgaggtagggccttcgcctccagccccacccgggccggagtggggcgggcagggcagggctgtcgacctgcaatttgtgtcccgaagcaataaagggaatgctgccgactca

SEQ ID NO: 376 - DNA, 633 bp, Oreochromis niloticus
tggggagacaaacaatttttggatctggtgctgaaagatgagactactggctttggctgtggtttgcgctctcattgctatccaggatggagggagtgtgggagcagctctgccaggagtcgaccctgcacagagaacacatgcaacaggagcagtgtcctctgcattcaggagaacagcaggcgacttcctggcagaggatcccagcctctgcttttccctgagagagaacgaggaccagaggcagctcctttgcaatgatcgcagaagtaatttcaactacaaccctctcagccttcgctttgggaaacgctacaatggctacatttacagaagagctgttaaaagagccagaacaaaaaagttttcacccttctctctgttcttgcgagaactggaggtacccacctgaaacagaagactttctctggggaattatgttatttgtttggaaagtcaaactgtgacagcagtgttcttaaaactctttatttcagaaaaaaaggtttccctgattaaaacttttgcacctatctttaatgtaaaataattttcagatgctacaatggagagaactatgtaaataaaatacttttagagagctaaaaaaaaaaaaaaaaaaaaaaaaaaaaa

SEQ ID NO: 377 - DNA, 216 bp, Artificial Sequence
  Description of Artificial Sequence: Synthetic polynucleotide
gtgtttcagcggcgccctctccagaagaagaggagggtagtgcacccacagcaggccctgacgtggaggagtggatggtgacacaagtggggcctggcgtggctgctgtccccatcggggaggagacgactgcaatcccaggcttcaccgttgagccagaaaacaagacggaatgggaacttgcctacaccccagcgggcactttgccactaccag

SEQ ID NO: 378 - DNA, 4084 bp, Artificial Sequence
  Description of Artificial Sequence: Synthetic polynucleotide
tcctttcctccagggatccctcctacatggcctcccactggagaagcaacagaggagcacacagaaggcccttctgcaacggaagtgccctcagcctcagagaagccgttcccttcagaggaaccattccccccagaggaaccattcccctcagagaaaccattccccccagaggaactgttcccctcagagaagccattcccctcagaaaagccgttcccctcagaggaaccgttcccctcagaaaaaccattccccccagaggaactgttcccctcagagaagccaatcccctcagaggagccattcccctcagaggagccattcccctcagagaagccattccccccagaggaaccattcccctcagagaaaccaatcccctcagaggagcctttcccctcagagaagccattcccttcagaggagccattcccctcagaggagccatccacactttcagccccagtgcccagcaggactgagctgccaagctctggggaggtgtctggggtgcccgaaatcagtggtgacttcacaggcagtggagaaatttcaggacacctagacttcagtgggcagccctcaggggaaagtgcaagtggactgccctctgaagaccttgactccagtgggctcacctctacagtgggctcaggcctgcctgtggaaagtggactgccttcaggggaagaagagagaattacatggaccagtgctcctaaagttgacaggttgccctctgggggtgagggcccagaagtttctggagtagaggatatcagtggacttccttctggaggagaggttcatctagagatctctgcctctggagtagaggacatcagtggacttccttctggaggagaggttcatctagagatctctgcctctggagtagaggacctaagtagaattccttctggagaaggtccagaaatctctgcctctggagtagaggacatcagtggacttccttctggagaggaaggtcatctagagatctctgcctctggagtagaagacctcagtggaattccttctggagaaggtccagaagtctctgcttctggagtagaggaccttattggacttccttctggagaaggtccagaagtctctgcttctggagtagaggacctcagtagacttccttctggagaaggtccagaagtctctgcttctggggtagaggaccttagtggacttccttctggagaaggtccagaagtctctgtttctggagtagaggatctcagcagacttccttctggagaaggtccagaagtctctgcttctggagtagaggacctcagtagacttccttctggagaaggtccagaaatctctgtgtctggagtagaggacatcagtatacttccttctggagaaggtccagaagtctctgcctctggagtagaggacctcagtgttcttccttctggagaaggtcatctagagatctctacctctggagtagaggacctcagtgttcttccttctggtgaaggtcatctagagatctctgcctctggagtagaggacatcagtagacttccttctggagaaggtccagaagtctctgcctctggagtagaggacctcagtgttcttccttctggagaagatcatctagagatctctgcctctggagtagaggacctcggtgttcttccttctggagaagatcatctagagatctctgcctctggagtagaggacatcagtagacttccttctggagaaggtccagaagtctctgcctctggagtagaggacctcagtgttcttccttctggagaaggtcatctagagatctctgcctctggagtagaggacctcagtagacttccttctggaggagaggatcatctagagacttctgcttctggagtaggggaccttagtggacttccttctggaagggaaggtctggagatctctgcttctggagctggggatcttagtgggttgacttctggaaaagaagacttgactgggtcagcttctggagccttggaccttggcagaataccttctgtaactctaggaagtgggcaagctccagaagcaagtggtcttccttctggatttagtggtgagtattctggggtggaccttgaaagtggcccatcctctggccttcctgatttcagtggacttccatctgggttcccaactgtctccctagtggatactacattggtggaagtcgtcacagccaccacagcaggtgaactagaaggaaggggaaccattgacatcagcggtgctggagaaacatctgggctgcccttcagtgagttggacattagtggaggagcaagcggactctcttcaggagctgaactcagtggccaagcatctgggtctcctgacatcagtggggaaacctctggactctttggtgtcagtggacagccctcagggtttcctgacattagtggggaaacttccgggcttcttgaggtcagtgggcagccatcagggttttatggagaaatatctggcgtgactgagcttagcggactggcctctggacaaccagaaatcagtggagaagcttctggaattctttctggccttggtccaccattcggcataaccgacctgagcggagaagcacccgggatccctgatctcagtgggcaaccatcgggcttgccagagttcagtgggacaacatccgggatccctgacctggtttccagtgctgtgagtggcagtggtgaatcttctggcattacgttcgtggacaccagtttggttgaagtgaccccaacgacatttaaagaagaagaaggcttaggatctgtggaactcagtggcctcccttcaggagaggtgggtgtctcaggcacatctgggctagcggatgtcagtggactgtcttctggagcaattgactccagtgggtttacgtcccagcctccagaattcagtggcctgccaagcggagtaactgaggtcagtggagaagcctccggagctgaaagtgggagcagcctgccctccggagcatatgacagcagtggacttccgtctggtttccccactgtctcttttgtagacaggactttggtggaatctgtaacccaggctccaactgctcaagaagcaggagaagggccttcaggcattctggaacttagcggtgcgccttctggagcaccagacatgtctggagaccatttgggatctttggaccaaagtgggcttcagtctggactagtggagcccagtggggagcccgcaagtactccatattttagtggggacttttctggcaccactgatgtaagtggggaatcctctgcagccacgagcaccagtggggaggcctccggacttccagaagttacgttaatcacatctgagttggtggagggagttactgaaccaaccgtttcccaggaactgggccagagaccccccgtaacatacaccccccagctttttgaatccagtggtgaagcctctgcatctggggatgtgccaaggttccctggatcgggggtagaagtgtcatcagtcccagaatccagcggtgagacgtcagcctatcccgaggctgaggtgggagcatctgctgcccccgaggcaagcggaggagcttccgggtcccctaacctgagtgaaaccacctccaccttccatgaagctgatctggagggaacctcaggcctgggagtgagtggcagcccctcagcctttccagaaggccccacggagggcttggccaccccggaagtgagtggagagtcaaccactgcctttgacgtgagcgtagaggcatcaggctcaccttctgccactcccctggcttctggagacaggactgacaccagcggagatctgtctggccacacctcggggctggatattgtcatcagcaccaccatcccagaatccgagtggactcagcagacccagcgccctgcagaggcgcgtctagaaatcgaatcctcaagccctgtgcactcaggagaagagagccaaacagccgacacagccacctccccgactgatgcttctatcccagcctccgcaggagggacagatgattcagaggcaaccacaacag

SEQ ID NO: 379 - DNA, 173 bp, Sus scrofa
gtcaaaaatgtaatgaagaatatcatggctggattgcaacaaactaacagtgaaaagatactcctgagctgggtccgacaatcaactcgtaattatccacaggttaatgtcattaacttcaccaccagctggtctgatggtctggctttgaatgctctcatccacagtcatag

SEQ ID NO: 380 - DNA, 119 bp, Sus scrofa
gccagacctgtttgattggaatagtgtggtttgccagcagtcagccacacaacgactggaacatgcattcaacatcgccaagtatcagttaggcatagagaaactactggatcctgaag

SEQ ID NO: 381 - DNA, 1604 bp, Artificial Sequence
  Description of Artificial Sequence: Synthetic polynucleotide
atcgaacctgggtcttctgcattggctggcagattctttaccactgagccaccacaccctagagtgcaaagggggcttagcaccacaggaggttcacaaagatgtaagctgttcttattaaggctgaggtgggggttgggagaagggggagaaaaagttttgtaagttgttaatttataataaatccccaaagaaatggtctttcaagtacatacttatctaaaactttgtcaataggggaaatgttcttaggagagaaaaggaattttttcttttagcataaagctgactttctaatatgggcttccctagtagctcagctggtgaagaacccgcctgcaatgtgggaaacctgggtttgagccctgggttgggaagatcccctggagaaaagaatggctacccactccagtattctggcctggagaattccatggactgtataccatggggttgcaaagagttggacacgactgagtgactttcattttcactttctgactttctaatattcgaggaatgcttagaagtgtggccggtagaaaatagtcctttgtgcctgggacttcaagaaggcggcactatcttgatggaactcagtctcatcacctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttctggtaggctggtattctctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttctttgctctttagatcaaaactctcttttcatttttaagtctatcccaaaagtgtgggaggtgtccttgatgttgaattataggcagagggtcagtttatcaacacccaagaccaacatctctgcctttgataagagatagaaatagaagtggagagagaggaggaaaaacatgactcacgatacattctgggttgtttgtttttgtttttatttttgttttggaaggagcgggtgggggaacgtgctgattaaagaaagtctagagagaacaagattcttaaaaataaatccacagtgaagcccagcgggtggggatttcccacagattttcagggcttttttgtgttgtcatggggatattagtcaatgttggtgtcttattttggagtcactatgagtgaaccatgtttaaggagctatggctcagctgctaaactattttcaaaaggaaaatggtgtgttacggtttccgagcagtggggccctggtacaggtaatatcatactcaaaagcactcttttgtgctacatgaatgaatcctgctaaaccatgcggac

SEQ ID NO: 382 - DNA, 90 bp, Bos taurus
ggccctgggcatggccggcaccacagccacttcgctggaccaaacagaccaacatgctttaaaagcctcaaaaaccattgaaactggcag

SEQ ID NO: 383 - DNA, 90 bp, Artificial Sequence
  Description of Artificial Sequence: Synthetic oligonucleotide
ggccctgggcatggccggcaccacagccacttctctagaccaaacagaccaacatgtttaaaagcctcaaaaaccattgaaactggcagg

SEQ ID NO: 384 - DNA, 90 bp, Artificial Sequence
  Description of Artificial Sequence: Synthetic oligonucleotide
ggccctgggcatggccggcaccacagccacttcgctggaccaaacagaccaacatgtttaaaagcctcaaaaaccattgaaactggcagg

SEQ ID NO: 385 - DNA, 228 bp, Bos taurus
ctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttcttggtaggctggtattct

SEQ ID NO: 386 - DNA, 430 bp, Unknown
  Description of Unknown: Polled gene sequence
ctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttcttggtaggctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttctt

SEQ ID NO: 387 - DNA, 827 bp, Bos taurus
atcgaacctgggtcttctgcattggctggcagattctttaccactgagccaccacaccctagagtgcaaagggggcttagcaccacaggaggttcacaaagatgtaagctgttcttattaaggctgaggtgggggttgggagaagggggagaaaaagttttgtaagttgttaatttataataaatccccaaagaaatggtctttcaagtacatacttatctaaaactttgtcaataggggaaatgttcttaggagagaaaaggaattttttcttttagcataaagctgactttctaatatgggcttccctagtagctcagctggtgaagaacccgcctgcaatgtgggaaacctgggtttgagccctgggttgggaagatcccctggagaaaagaatggctacccactccagtattctggcctggagaattccatggactgtataccatggggttgcaaagagttggacacgactgagtgactttcattttcactttctgactttctaatattcgaggaatgcttagaagtgtggccggtagaaaatagtcctttgtgcctgggacttcaagaaggcggcactatcttgatggaactcagtctcatcacctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttcttggtagg

SEQ ID NO: 388 - DNA, 555 bp, Bos taurus
tgctctttagatcaaaactctcttttcatttttaagtctatcccaaaagtgtgggaggtgtccttgatgttgaattataggcagagggtcagtttatcaacacccaagaccaacatctctgcctttgataagagatagaaatagaagtggagagagaggaggaaaaacatgactcacgatacattctgggttgtttgtttttgtttttatttttgttttggaaggagcgggtgggggaacgtgctgattaaagaaagtctagagagaacaagattcttaaaaataaatccacagtgaagcccagcgggtggggatttcccacagattttcagggcttttttgtgttgtcatggggatattagtcaatgttggtgtcttattttggagtcactatgagtgaaccatgtttaaggagctatggctcagctgctaaactattttcaaaaggaaaatggtgtgttacggtttccgagcagtggggccctggtacaggtaatatcatactcaaaagcactcttttgtgctacatgaatgaatcctgctaaaccatgcgga

SEQ ID NO: 389 - DNA, 30 bp, Sus scrofa
gccgccgaggcgaaccctcgggggacctca

SEQ ID NO: 390 - DNA, 30 bp, Artificial Sequence
  Description of Artificial Sequence: Synthetic oligonucleotide
gccgctgaagcgaaccctcgggggacctca

SEQ ID NO: 391 - DNA, 20 bp, Artificial Sequence
  Description of Artificial Sequence: Synthetic oligonucleotide
ggtcccccgagggttcgcct

SEQ ID NO: 392 - DNA, 91 bp, Sus scrofa
ggagctctcgggaggctggcacgatgaggtcccccgagggttcgcttcagcggcagcgggctttctctccgcacaccgcgggccctgctcc

SEQ ID NO: 393 - DNA, 38 bp, Artificial Sequence
  Description of Artificial Sequence: Synthetic oligonucleotide
gccgccgagtaaagcttgcgaaccctcgggggacctca

SEQ ID NO: 394 - DNA, 90 bp, Artificial Sequence
  Description of Artificial Sequence: Synthetic oligonucleotide
ctctcgggaggctggcacgatgaggtcccccgagggttcgcaagctttactcggcggcagcgggctttctctccgcacaccgcgggccct

SEQ ID NO: 395 - DNA, 21 bp, Bos taurus
gcaatcccaggcttcaccgtt

SEQ ID NO: 396 - DNA, 21 bp, Bos taurus
acggaatgggaacttgcctac

SEQ ID NO: 397 - DNA, 20 bp, Bos taurus
cctttcctccagggatccct

SEQ ID NO: 398 - DNA, 22 bp, Bos taurus
actggagaagcaacagaggagc

SEQ ID NO: 399 - DNA, 4332 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 400 - DNA, 4332 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 401 - DNA, 4230 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 402 - DNA, 4434 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 403 - DNA, 3261 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 404 - DNA, 3465 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 405 - DNA, 30 bp, Bos taurus
ccctgaacctgaccccggaccaagtggtgg

SEQ ID NO: 406 - DNA, 3363 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 407 - DNA, 3057 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 408 - DNA, 4026 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 409 - DNA, 4230 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 410 - DNA, 3056 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaactttaa

SEQ ID NO: 411 - DNA, 3261 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 412 - DNA, 4332 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 413 - DNA, 4026 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 414 - DNA, 3260 bp, Artificial Sequence
  Description of Artificial Sequence: Synthetic polynucleotide
taggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactctagaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctgggtaccgggccccccctcgaggtcgacggtatcgataagcttgcttgttctttttgcagaagctcagaataaacgctcaactttggcagatctaactcgagaaagatattgtatatatcgtaacaataggaggttcaaca

SEQ ID NO: 415 - DNA, 4332 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 416 - DNA, 2955 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 417 - DNA, 3363 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 418 - DNA, 4230 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 419 - DNA, 3822 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 420 - DNA, 3261 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 421 - DNA, 2853 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 422 - DNA, 5046 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 423 - DNA, 4332 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 424 - DNA, 3363 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 425 - DNA, 2955 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 426 - DNA, 30 bp, Bos taurus; identical to SEQ ID NO: 405

SEQ ID NO: 427 - DNA, 30 bp, Bos taurus
aacgaccacctcgtcgccttggcctgcctc

SEQ ID NO: 428 - DNA, 3567 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 429 - DNA, 30 bp, Bos taurus; identical to SEQ ID NO: 405

SEQ ID NO: 430 - DNA, 30 bp, Bos taurus; identical to SEQ ID NO: 427

SEQ ID NO: 431 - DNA, 3567 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 432 - DNA, 30 bp, Bos taurus; identical to SEQ ID NO: 405

SEQ ID NO: 433 - DNA, 30 bp, Bos taurus; identical to SEQ ID NO: 427

SEQ ID NO: 434 - DNA, 3159 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 435 - DNA, 30 bp, Bos taurus; identical to SEQ ID NO: 405

SEQ ID NO: 436 - DNA, 30 bp, Bos taurus; identical to SEQ ID NO: 427

SEQ ID NO: 437 - DNA, 3363 bp, Artificial Sequence
  Description of Artificial Sequence: Synthetic polynucleotide
atggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 438 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 439 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 440 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 441 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 442 - DNA, 5637 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 443 - DNA, 5637 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 444 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 445 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 446 - DNA, 6249 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 447 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 448 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 449 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 450 - DNA, 6249 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 451 - DNA, 6555 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 452 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 453 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 454 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 455 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 456 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 457 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 458 - DNA, 6351 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 459 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 460 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 461 - DNA, 6453 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 462 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 463 - DNA, 6249 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 464 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 465 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 466 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 467 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 468 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 469 - DNA, 5880 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcg

SEQ ID NO: 470 - DNA, 6147 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 471 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 472 - DNA, 6147 bp, Artificial Sequence; identical to SEQ ID NO: 470
  Description of Artificial Sequence: Synthetic polynucleotide

SEQ ID NO: 473 - DNA, 6045 bp, Artificial Sequence; identical to SEQ ID NO: 471
  Description of Artificial Sequence: Synthetic polynucleotide

SEQ ID NO: 474 - DNA, 6147 bp, Artificial Sequence; identical to SEQ ID NO: 470
  Description of Artificial Sequence: Synthetic polynucleotide

SEQ ID NO: 475 - DNA, 6045 bp, Artificial Sequence; identical to SEQ ID NO: 471
  Description of Artificial Sequence: Synthetic polynucleotide

SEQ ID NO: 476 - DNA, 6147 bp, Artificial Sequence; identical to SEQ ID NO: 470
  Description of Artificial Sequence: Synthetic polynucleotide

SEQ ID NO: 477 - DNA, 6045 bp, Artificial Sequence; identical to SEQ ID NO: 471
  Description of Artificial Sequence: Synthetic polynucleotide

SEQ ID NO: 478 - DNA, 6249 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 479 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 480 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 481 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 482 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 483 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 484 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 485 - DNA, 6249 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 486 - DNA, 5637 bp, Artificial Sequence; identical to SEQ ID NO: 442
  Description of Artificial Sequence: Synthetic polynucleotide

SEQ ID NO: 487 - DNA, 5637 bp, Artificial Sequence; identical to SEQ ID NO: 443
  Description of Artificial Sequence: Synthetic polynucleotide

SEQ ID NO: 488 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 489 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 490 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 491 - DNA, 5943 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 492 - DNA, 5739 bp, Artificial Sequence; identical to SEQ ID NO: 454
  Description of Artificial Sequence: Synthetic polynucleotide

SEQ ID NO: 493 - DNA, 5943 bp, Artificial Sequence; identical to SEQ ID NO: 455
  Description of Artificial Sequence: Synthetic polynucleotide

SEQ ID NO: 494 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 495 - DNA, 6045 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 496 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 497 - DNA, 5739 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 498 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 499 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 500 - DNA, 5841 bp, Artificial Sequence
  Description of Artificial Sequence: Synthetic polynucleotide
ttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgaattaaccctcactaaagggaagcttgcttgttctttttgcagaagctcagaataaacgctcaactttggcagatctaactcgagaaagatattgtatatatcgtaacaataggaggttcaacaatggcttcctcccctccaaagaaaaagagaaaggttagttggaaggacgcaagtggttggtctagagtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgcctctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaataggctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctaaaaaaaaaaaaaaaaaaaaaaaaaaaaaaccccccccccccccccccccccccccccccgcatgcctgcaggtcgactaggatccccgggtaccgagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttattt

SEQ ID NO: 501 - DNA, 75 bp, Artificial Sequence
  Description of Artificial Sequence: Synthetic oligonucleotide
ggagagattttgggcttgattgtgacagaatctcgatgctgtcgttaccctctaactgtggattttgaagctttt

SEQ ID NO: 502 - DNA, 76 bp, Artificial Sequence; identical to SEQ ID NO: 134
  Description of Artificial Sequence: Synthetic oligonucleotide

SEQ ID NO: 503 - DNA, 72 bp, Artificial Sequence
  Description of Artificial Sequence: Synthetic oligonucleotide
cctaaaagatataaggccaattactgctctggagaatatgaattcgtatttttgcaaaagtatcctcatacc

SEQ ID NO: 504 - DNA, 1648 bp, Artificial Sequence
  Description of Artificial Sequence: Synthetic polynucleotide
atatgcggccgcgatgtattcctcagacttttccatataaaaggaaaaatgtctcaaattcatgaaaagattggtacaggaggaggattagcaaattgtagtttaaatatctgaatggaaacattttttagtgaaagaataaagggaatatcattgtatcttcttctgagtctgtgcctctctctcttggagttagtctttccaaccctatatacttaccactatcttcatccctctaccttcctttttcccattacatctgtgcagtactgggtggcaactattgtgtttcggtgttaacatccaagtttccctgaataagaccaagtgaatggaggatgaatgagtatacctatccctccaggagtcatcagacatatttagccaccatatttaatcaataagcaggaagacataagctagccttgtccctcttctttcctccctgctcctttctcttctcttccccctctccctttactgtcatccatcagtattttcacagcatctattatgtgtcaggcattcagatactcaaacggaggaaaacaagaataaacaagacaaagatctgaccacaggggaatccctatggctactatagacttttgagccataaaggaagaatcaagcctagtgtaaatgaaaattccttaatgctgtgccttttaaaaagaaatgtgacataagcaaaatgattagttttctttctttaataatgagtccttgaggtaggagagtgttttgggatctattattaactcttctttcctttccatacagactccttttttagaagtcaaggtaacagacacaccaaaaagatctaggagagattttgggcttgattgtgacagaatctcgatgctgtcgttaccctctaactgtggattttgaagcttttggatgggattggattattgcacctaaaagatataaggccaattactgctctggagaatgtgaatttgtatttttgcaaaagtatcctcatacccatcttgtgcaccaagcaaaccccagaggttcagccggcccctgctgtactcctacaaagatgtctccaattaatatgctatattttaatggcgaaggacaaataatatacgggaagattccagccatggtagtagatcgctgtgggtgttcatgaggtctatatttggttcatagcttcctcaaacatggaaggtcttcccctcaacaattttgaaactgtgaaattatgtaccacaggctataagcctagagtatgctacagtcacttaagcacaagctacagtatatgagctaaaaagagagaatatatgctatggttggcatttaaccatcaaaacaaatcgtataataaaacgttttatgatttccagagtttttgaactaggagatcaaattccatttatgttcaaatatatcacaacacatgcaggtgaatgaaagcaattctccttgtcttctggtgaattaaaggagtatgctttaaaatctatttctttacagtttcacttaatatttacagaaaaatctatatgtagtattggtaaaatgcagtattgttatataccattatttgaaacatccttaaacacttgaatttatattgtatgatagcatacttggtaagatgagattccacgcggccgcatat

SEQ ID NO: 505 - DNA, 4519 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcgatgtattcctcagacttttccatataaaaggaaaaatgtctcaaattcatgaaaagattggtacaggaggaggattagcaaattgtagtttaaatatctgaatggaaacattttttagtgaaagaataaagggaatatcattgtatcttcttctgagtctgtgcctctctctcttggagttagtctttccaaccctatatacttaccactatcttcatccctctaccttcctttttcccattacatctgtgcagtactgggtggcaactattgtgtttcggtgttaacatccaagtttccctgaataagaccaagtgaatggaggatgaatgagtatacctatccctccaggagtcatcagacatatttagccaccatatttaatcaataagcaggaagacataagctagccttgtccctcttctttcctccctgctcctttctcttctcttccccctctccctttactgtcatccatcagtattttcacagcatctattatgtgtcaggcattcagatactcaaacggaggaaaacaagaataaacaagacaaagatctgaccacaggggaatccctatggctactatagacttttgagccataaaggaagaatcaagcctagtgtaaatgaaaattccttaatgctgtgccttttaaaaagaaatgtgacataagcaaaatgattagttttctttctttaataatgagtccttgaggtaggagagtgttttgggatctattattaactcttctttcctttccatacagactccttttttagaagtcaaggtaacagacacaccaaaaagatctaggagagattttgggcttgattgtgacagaatctcgatgctgtcgttaccctctaactgtggattttgaagcttttggatgggattggattattgcacctaaaagatataaggccaattactgctctggagaatgtgaatttgtatttttgcaaaagtatcctcatacccatcttgtgcaccaagcaaaccccagaggttcagccggcccctgctgtactcctacaaagatgtctccaattaatatgctatattttaatggcgaaggacaaataatatacgggaagattccagccatggtagtagatcgctgtgggtgttcatgaggtctatatttggttcatagcttcctcaaacatggaaggtcttcccctcaacaattttgaaactgtgaaattatgtaccacaggctataagcctagagtatgctacagtcacttaagcacaagctacagtatatgagctaaaaagagagaatatatgctatggttggcatttaaccatcaaaacaaatcgtataataaaacgttttatgatttccagagtttttgaactaggagatcaaattccatttatgttcaaatatatcacaacacatgcaggtgaatgaaagcaattctccttgtcttctggtgaattaaaggagtatgctttaaaatctatttctttacagtttcacttaatatttacagaaaaatctatatgtagtattggtaaaatgcagtattgttatataccattatttgaaacatccttaaacacttgaatttatattgtatgatagcatacttggtaagatgagattccacgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 506 - DNA, 90 bp, Artificial Sequence
  Description of Artificial Sequence: Synthetic oligonucleotide
ccgagacgggaaatgcacctcctacaagtggatttgtgatggatccgaacaccgagtgcaaggacgggtccgctgagtccctggagacgt

SEQ ID NO: 507 - DNA, 90 bp, Artificial Sequence
  Description of Artificial Sequence: Synthetic oligonucleotide
cccaaaagatataaggccagttactgctctggagagtatgaattcgtatttttacaaaaataccctcacactcatcttgtgcaccaagca

SEQ ID NO: 508 - DNA, 46 bp, Artificial Sequence; identical to SEQ ID NO: 242
  Description of Artificial Sequence: Synthetic oligonucleotide

SEQ ID NO: 509 - DNA, 90 bp, Artificial Sequence; identical to SEQ ID NO: 244
  Description of Artificial Sequence: Synthetic oligonucleotide

SEQ ID NO: 510 - DNA, 90 bp, Artificial Sequence; identical to SEQ ID NO: 506
  Description of Artificial Sequence: Synthetic oligonucleotide

SEQ ID NO: 511 - DNA, 90 bp, Artificial Sequence
  Description of Artificial Sequence: Synthetic oligonucleotide
tgccgagacgggaaatgcacctcctacaagtggatttgtgggatccacaccgagtgcaaggacgggtccgctgagtccctggagacgtgc

SEQ ID NO: 512 - DNA, 60 bp, Artificial Sequence; identical to SEQ ID NO: 243
  Description of Artificial Sequence: Synthetic oligonucleotide

SEQ ID NO: 513 - DNA, 86 bp, Artificial Sequence; identical to SEQ ID NO: 246
  Description of Artificial Sequence: Synthetic oligonucleotide

SEQ ID NO: 514 - DNA, 90 bp, Artificial Sequence; identical to SEQ ID NO: 158
  Description of Artificial Sequence: Synthetic oligonucleotide

SEQ ID NO: 515 - DNA, 90 bp, Artificial Sequence
  Description of Artificial Sequence: Synthetic oligonucleotide
agctcgccacccccgccgggcacccgtgtccgcgccatggccatctaagcttaaagaagtcagagtacatgcccgaggtggtgaggcgct

SEQ ID NO: 516 - DNA, 90 bp, Artificial Sequence; identical to SEQ ID NO: 351
  Description of Artificial Sequence: Synthetic oligonucleotide

SEQ ID NO: 517 - DNA, 90 bp, Artificial Sequence; identical to SEQ ID NO: 353
  Description of Artificial Sequence: Synthetic oligonucleotide

SEQ ID NO: 518 - DNA, 90 bp, Artificial Sequence
  Description of Artificial Sequence: Synthetic oligonucleotide
gggcctctgggctcaccaacggtctcctcccgggggacgaagacttctcctccattgcggacatggacttctcagcccttctgagtcaga

SEQ ID NO: 519 - DNA, 90 bp, Artificial Sequence
  Description of Artificial Sequence: Synthetic oligonucleotide
gtgctgcgtgccctttactgctctactctaccccctaccagcctaagcttgtgctgggcgacttcatgtgcaagttcctcaactacatcc

SEQ ID NO: 520 - DNA, 4536 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 521 - DNA, 4536 bp, Artificial Sequence
  Description of Artificial Sequence: Synthetic polynucleotide
atggcttcctcccctccaaagaaaaagagaaaggttagttggaaggacgcaagtggttggtctagaatgcatgcggatcccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatccgatatctagatcccagctagtgaaatctgaattggaagagaagaaatctgaacttagacataaattgaaatatgtgccacatgaatatattgaattgattgaaatcgcaagaaattcaactcaggatagaatccttgaaatgaaggtgatggagttctttatgaaggtttatggttatcgtggtaaacatttgggtggatcaaggaaaccagacggagcaatttatactgtcggatctcctattgattacggtgtgatcgttgatactaaggcatattcaggaggttataatcttccaattggtcaagcagatgaaatgcaaagatatgtcgaagagaatcaaacaagaaacaagcatatcaaccctaatgaatggtggaaagtctatccatcttcagtaacagaatttaagttcttgtttgtgagtggtcatttcaaaggaaactacaaagctcagcttacaagattgaatcatatcactaattgtaatggagctgttcttagtgtagaagagcttttgattggtggagaaatgattaaagctggtacattgacacttgaggaagtgagaaggaaatttaataacggtgagataaacttttaa

SEQ ID NO: 522 - DNA, 591 bp, Artificial Sequence
  Description of Artificial Sequence: Synthetic polynucleotide
gaaggcggcactatcttgatggaactcagtctcatcacctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttcttggtaggctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttctttgctctttagatcaaaactctcttttcatttttaagtctatcccaaaagtgtgggaggtgtccttgatgttgaattataggcagagggtcagtttatcaacacccaagaccaacatctctgcc

SEQ ID NO: 523 - DNA, 52 bp, Sus scrofa
tctcctacaagtggatttgtgatgggaacaccgagtgcaaggacgggtccga

SEQ ID NO: 524 - DNA, 56 bp, Artificial Sequence
  Description of Artificial Sequence: Synthetic oligonucleotide
cctcctacaagtggatttgtgatggatccgaacaccgagtgcaaggacgggtccgc

SEQ ID NO: 525 - DNA, 82 bp, Bos taurus
ctgggcatggccggcaccacagccacttcgctggaccaaacagaccaacatgtttaaaagcctcaaaaaccattgaaactgg

SEQ ID NO: 526 - DNA, 1392 bp, Bos taurus
atcgaacctgggtcttctgcattggctggcagattctttaccactgagccaccacaccctagagtgcaaagggggcttagcaccacaggaggttcacaaagatgtaagctgttcttattaaggctgaggtgggggttgggagaagggggagaaaaagttttgtaagttgttaatttataataaatccccaaagaaatggtctttcaagtacatacttatctaaaactttgtcaataggggaaatgttcttaggagagaaaaggaattttttcttttagcataaagctgactttctaatatgggcttccctagtagctcagctggtgaagaacccgcctgcaatgtgggaaacctgggtttgagccctgggttgggaagatcccctggagaaaagaatggctacccactccagtattctggcctggagaattccatggactgtataccatggggttgcaaagagttggacacgactgagtgactttcattttcactttctgactttctaatattcgaggaatgcttagaagtgtggccggtagaaaatagtcctttgtgcctgggacttcaagaaggcggcactatcttgatggaactcagtctcatcacctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttcttggtaggctggtattcttgctctttagatcaaaactctcttttcatttttaagtctatcccaaaagtgtgggaggtgtccttgatgttgaattataggcagagggtcagtttatcaacacccaagaccaacatctctgcctttgataagagatagaaatagaagtggagagagaggaggaaaaacatgactcacgatacattctgggttgtttgtttttgtttttatttttgttttggaaggagcgggtgggggaacgtgctgattaaagaaagtctagagagaacaagattcttaaaaataaatccacagtgaagcccagcgggtggggatttcccacagattttcagggcttttttgtgttgtcatggggatattagtcaatgttggtgtcttattttggagtcactatgagtgaaccatgtttaaggagctatggctcagctgctaaactattttcaaaaggaaaatggtgtgttacggtttccgagcagtggggccctggtacaggtaatatcatactcaaaagcactcttttgtgctacatgaatgaatcctgctaaaccatgcgga

SEQ ID NO: 527 - protein, 4 aa, Artificial Sequence
  Description of Artificial Sequence: Synthetic peptide
DEAH

SEQ ID NO: 528 - DNA, 1215 bp, Oreochromis niloticus
aactcctgtcacgatgtactcctccgaggagctgtggaactccaccgagcaggtctggatcaacggatccggaacaaacttctctctaggaagacacgaggacgatgaggaggaggaaggagacaagcatcctttcttcacggatgcctggctggtccctctgttcttctctctcatcatgctggtcggactggtgggcaactctctggtcatttatgtcatttcaaaacacagacagatgaggacggcaaccaacttctacatagcaaacctggccgccactgacatcatcttcttggtgtgctgcgtccccttcaccgccaccctttaccccctccctggatggatctttggcaacttcatgtgcaaatttgtcgcctttctgcagcaggtgacggtgcaagccacctgcatcaccctgactgctatgagtggagaccgctgttacgtgacagtctaccccctgaaatctcttcggcaccgaacccccaaagtagccatgattgtcagcatttgcatttggatcggttctttcgtcctctctacaccaattttaatgtaccagcgtatagaggagggctactggtacggcccgaggcaatactgcatggagagatttccctctaagacgcatgagagggctttcatcctgtaccagttcattgctgcctacctgctgcctgtgctcactatctctttctgctacactctgatggttaagagggttggccagcccactgtagaacctgtagacaataattatcaggtgaatctcctgtctgagagaacaatcagcatccggagcaaagtttccaagatggtggtagtgattgtgcttctctttgccatctgctgggggcccatccagatctttgtcctcttccagtctttctatcctaactaccagcctaactacgccacatacaagatcaagacgtgggccaactgcatgtcctacgccaactcctctgtcaaccccatagtttatggcttcatgggagctagtttccaaaagtctttcaggaaaacttttcccttcctgttcaagcacaaggtcagagacagcagcatggcttcaaggactgccaatgctgagattaagtttgttgctgcggaggaaggcaacaataataacgcggtgaactgatcccgatcatttaacataagaaggatagggacagttttctaatgagaatcctgaaaaaaaaaaaaaaa

SEQ ID NO: 529 - protein, 377 aa, Oreochromis niloticus
MYSSEELWNSTEQVWINGSGTNFSLGRHEDDEEEEGDKHPFFTDAWLVPLFFSLIMLVGLVGNSLVIYVISKHRQMRTATNFYIANLAATDIIFLVCCVPFTATLYPLPGWIFGNFMCKFVAFLQQVTVQATCITLTAMSGDRCYVTVYPLKSLRHRTPKVAMIVSICIWIGSFVLSTPILMYQRIEEGYWYGPRQYCMERFPSKTHERAFILYQFIAAYLLPVLTISFCYTLMVKRVGQPTVEPVDNNYQVNLLSERTISIRSKVSKMVVVIVLLFAICWGPIQIFVLFQSFYPNYQPNYATYKIKTWANCMSYANSSVNPIVYGFMGASFQKSFRKTFPFLFKHKVRDSSMASRTANAEIKFVAAEEGNNNNAVN

SEQ ID NO: 530 - DNA, 59 bp, Artificial Sequence
  Description of Artificial Sequence: Synthetic oligonucleotide
tttcaactacaaccctctcagccttcgctttgggaacgctttattaacgctacaatggc

SEQ ID NO: 531 - DNA, 59 bp, Artificial Sequence
  Description of Artificial Sequence: Synthetic oligonucleotide
tttcaactacaaccctctcagccttcgctttgggagggaaacgctacaatggctacatt

SEQ ID NO: 532 - DNA, 55 bp, Artificial Sequence
  Description of Artificial Sequence: Synthetic oligonucleotide
tttcaactacaaccctctcagccttcgctgagacgctacaatggctacatttaca

SEQ ID NO: 533 - DNA, 61 bp, Artificial Sequence
  Description of Artificial Sequence: Synthetic oligonucleotide
gacagtctaccccctgaaatctcttcggcagatccccaaagtagccatgattgtcagcatt

SEQ ID NO: 534 - DNA, 50 bp, Artificial Sequence
  Description of Artificial Sequence: Synthetic oligonucleotide
gacagtctaccccctgaaatgtagccaaagtagccatgattgtcagcatt

SEQ ID NO: 535 - DNA, 38 bp, Artificial Sequence
  Description of Artificial Sequence: Synthetic oligonucleotide
gacagtctacccccaaagtagccatgattgtcagcatt

SEQ ID NO: 536 - DNA, 50 bp, Artificial Sequence
  Description of Artificial Sequence: Synthetic oligonucleotide
  modified_base (9)..(9): a, c, t, g, unknown or other
ggcaccccncagtaaccatgagttgattgatttcatttggattcggatcg

SEQ ID NO: 537 - DNA, 51 bp, Artificial Sequence
  Description of Artificial Sequence: Synthetic oligonucleotide
ggcaccgaacccccaaagtagccatgattgtcagcatttgcattcggatcg

SEQ ID NO: 538 - DNA, 53 bp, Artificial Sequence
  Description of Artificial Sequence: Synthetic oligonucleotide
gacagtctaccccctgaaatctcttcggcaaagtagccatgattgtcagcatt

SEQ ID NO: 539 - protein, 21 aa, Unknown
  Description of Unknown: kiss sequence
TVYPLKSLRHRTPKVAMIVSI

SEQ ID NO: 540 - DNA, 82 bp, Sus scrofa
agggcccgcggtgtgcggagagaaagcccgctgccgccgaggcgaaccctcgggggacctcatcgtgccagcctcccgagag

SEQ ID NO: 541 - protein, 27 aa, Sus scrofa
RARGVRRESPLPPRRTLGGPHRASLPR

SEQ ID NO: 542 - protein, 30 aa, Artificial Sequence
  Description of Artificial Sequence: Synthetic polypeptide
LSGGWHDEVPRGFASFTRRQRAFSPHTAGP

SEQ ID NO: 543 - DNA, 82 bp, Artificial Sequence; identical to SEQ ID NO: 540
  Description of Artificial Sequence: Synthetic oligonucleotide

SEQ ID NO: 544 - protein, 28 aa, Artificial Sequence
  Description of Artificial Sequence: Synthetic peptide
QGPRCAERKPAAAEANPRGTSSCQPPES

SEQ ID NO: 545 - DNA, 90 bp, Artificial Sequence
  Description of Artificial Sequence: Synthetic oligonucleotide
agggcccgcggtgtgcggagagaaagcccgctgccgccgagtaaagcttgcgaaccctcgggggacctcatcgtgccagcctcccgagag

SEQ ID NO: 546 - protein, 13 aa, Artificial Sequence
  Description of Artificial Sequence: Synthetic peptide
GPRCAERKPAAAE

SEQ ID NO: 547 - protein, 15 aa, Artificial Sequence
  Description of Artificial Sequence: Synthetic peptide
SLRTLGGPHRASLPR

SEQ ID NO: 548 - DNA, 90 bp, Artificial Sequence
  Description of Artificial Sequence: Synthetic oligonucleotide
gagctctcgggaggctggcacgatgaggtcccccgagggttcgcttcagcggcagcgggctttctctccgcacaccgcgggccctgctcc

SEQ ID NO: 549 - protein, 30 aa, Artificial Sequence
  Description of Artificial Sequence: Synthetic polypeptide
ELSGGWHDEVPRGFASAAAGFLSAHRGPCS

SEQ ID NO: 550 - DNA, 90 bp, Artificial Sequence
  Description of Artificial Sequence: Synthetic oligonucleotide
ggagcagggcccgcggtgtgcggagagaaagcccgctgccgccgaggcgaaccctcgggggacctcatcgtgccagcctcccgagagctc

SEQ ID NO: 551 - protein, 30 aa, Artificial Sequence
  Description of Artificial Sequence: Synthetic polypeptide
EQGPRCAERKPAAAEANPRGTSSCQPPESS

SEQ ID NO: 552 - DNA, 90 bp, Artificial Sequence
  Description of Artificial Sequence: Synthetic oligonucleotide
ggagcagggcccgcggtgtgcggagagaaagcccgctgccgctgaagcgaaccctcgggggacctcatcgtgccagcctcccgagagctc

SEQ ID NO: 553 - protein, 29 aa, Artificial Sequence
  Description of Artificial Sequence: Synthetic peptide
EQGPRCAERKPAAAEANPRGTSSCQPPES

SEQ ID NO: 554 - DNA, 39 bp, Sus scrofa
gctgccgccgaggcgaaccctcgggggacctcatcgtgc

SEQ ID NO: 555 - protein, 13 aa, Sus scrofa
AAAEANPRGTSSC

SEQ ID NO: 556 - DNA, 39 bp, Artificial Sequence
  Description of Artificial Sequence: Synthetic oligonucleotide
gctgccgctgaagcgaaccctcgggggacctcatcgtgc

SEQ ID NO: 557 - protein, 13 aa, Artificial Sequence
  Description of Artificial Sequence: Synthetic peptide
AAAEANPRGTSSC

SEQ ID NO: 558 - DNA, 30 bp, Unknown; identical to SEQ ID NO: 389
  Description of Unknown: kiss1 sequence

SEQ ID NO: 559 - DNA, 38 bp, Artificial Sequence; identical to SEQ ID NO: 393
  Description of Artificial Sequence: Synthetic oligonucleotide

SEQ ID NO: 560 - DNA, 38 bp, Artificial Sequence; identical to SEQ ID NO: 393
  Description of Artificial Sequence: Synthetic oligonucleotide

SEQ ID NO: 561 - DNA, 38 bp, Artificial Sequence; identical to SEQ ID NO: 393
  Description of Artificial Sequence: Synthetic oligonucleotide

SEQ ID NO: 562 - DNA, 45 bp, Artificial Sequence
  Description of Artificial Sequence: Synthetic oligonucleotide
gtgctgcgtgccctttactgctctactctaccccctaccagccta

SEQ ID NO: 563 - DNA, 44 bp, Artificial Sequence
  Description of Artificial Sequence: Synthetic oligonucleotide
gcttgtgctgggcgacttcatgtgcaagttcctcaactacatcc

SEQ ID NO: 564 - protein, 124 aa, Oreochromis niloticus
MRLLALAVVCALIAIQDGGSVGAALPGVDPAQRTHATGAVSSAFRRTAGDFLAEDPSLCFSLRENEDQRQLLCNDRRSNFNYNPLSLRFGKRYNGYIYRRAVKRARTKKFSPFSLFLRELEVPT

SEQ ID NO: 565 - protein, 45 aa, Oreochromis niloticus
NRRLSLGNYVICLESQTVTAVFLKLFISEKKVSLIKTFAPIFNVK

SEQ ID NO: 566 - protein, 13 aa, Oreochromis niloticus
SRSFNIRRIGTVF

What is claimed is:

1. A method for producing a livestock animal having a first allele of a gene of a first livestock breed replaced with a second allele of the gene, comprising:
   (a) providing
      (i) a cell or embryo from a livestock animal of a first livestock breed, wherein the cell or embryo comprises in its genome a first allele of a gene,
      (ii) a TALEN that specifically binds to and cleaves DNA at a specific site in the first allele of the gene; and
      (iii) a homology directed repair (HDR) template comprising a nucleic acid comprising a second allele of the gene, wherein the second allele was identified in a livestock animal of a second livestock breed;
   (b) introducing the TALEN and the HDR template into the cell or embryo, wherein the TALEN creates a double-stranded break in the specific site and the HDR template inserts into the double-stranded break, thereby inserting the second allele of the gene into the genome of the cell or embryo, thereby replacing the first allele of the gene with the second allele of the gene; and
   (c) (i) forming a nuclear transfer embryo from the cell of step (b) and transferring it into a surrogate female or (ii) transferring the embryo of step (b) into a surrogate female to produce a livestock animal having a first allele of a gene of a first livestock breed replaced with a second allele of the gene, wherein the second allele was identified in a livestock animal of the second livestock breed.

2. The method of claim 1, wherein the second allele of the gene is linked to a trait of the second livestock breed.

3. The method of claim 1, wherein the TALEN comprises a left TALEN and a right TALEN.

4. The method of claim 1, wherein the livestock animal of the first livestock breed is chosen from the group consisting of swine, cow, sheep, goat, chicken, rabbit, and fish.

5. The method of claim 1, wherein the first allele of the gene of the first livestock breed comprises a modification, relative to the second allele of the gene, that is chosen from the group consisting of an insertion, a deletion, a polymorphism, and a single nucleotide polymorphism (SNP).

6. The method of claim 1, wherein the second allele of the gene comprises a myostatin allele present in Belgian Blue cattle.

7. The method of claim 1, wherein said introducing of the TALEN comprises introducing an mRNA encoding the TALEN or introducing a vector comprising a nucleic acid sequence encoding the TALEN.

8. The method of claim 7, further comprising introducing into the cell or embryo a vector comprising a reporter gene, wherein introducing the vector comprising the report gene is independent of said introducing of the TALEN.

9. A method of producing a live gene-edited porcine or *bovine* animal comprising:
   (a) providing:
      (i) a primary somatic cell or an embryo from a porcine or *bovine* animal comprising in its genome a first allele of a gene;
      (ii) a transcription activator like effector fused to an endonuclease (TALEN) comprising an ability to target, bind, and cleave DNA in a specific site of the first allele of the gene to create a double-stranded break in the DNA at the specific site; and
      (iii) a homology directed repair (HDR) template comprising an exogenous nucleic acid sequence encoding a second allele of the gene flanked by DNA sequences that are homologous to the first allele of the gene;
   (b) introducing the TALEN and the HDR template into the primary somatic cell or the embryo, wherein the TALEN creates a double-stranded break in the DNA at the specific site in the first allele of the gene in the cell or embryo and the HDR template is inserted into the double-stranded break in the DNA; thereby producing an gene-edited porcine or *bovine* primary somatic cell or embryo; and (c) producing a gene-edited porcine or *bovine* animal by
  (i) introducing the gene-edited porcine or *bovine* primary somatic cell into an enucleated porcine or *bovine* oocyte to produce a nuclear transfer embryo and transferring the nuclear transfer embryo into a surrogate female to produce a live gene-edited porcine or *bovine* animal; or
  (ii) transferring the gene-edited porcine or *bovine* embryo into a surrogate female to produce a live gene-edited porcine or *bovine* animal.

10. The method of claim 9, wherein said introducing of the TALEN comprises introducing an mRNA encoding the TALEN.

11. The method of claim 9, wherein the method is performed without exposing the primary somatic cell or the embryo from the porcine or *bovine* animal to a reporter gene that, if incorporated into the chromosomal DNA of the primary somatic cell or the embryo confers a trait on the primary somatic cell or the embryo that permits isolation by survival selection criterion.

12. The method of claim 9, wherein the second allele is a natural allele of a different breed, a different species, or a different lineage than the primary somatic cell or the embryo provided in step (a)(i).

13. The method of claim 9, wherein the live gene-edited porcine or *bovine* animal is heterozygous for the second allele.

14. The method of claim 9, wherein the live gene-edited porcine or *bovine* animal is homozygous for the second allele.

15. The method of claim 9, wherein the first allele is a natural allele from a first breed and the second allele is a natural allele from a second breed.

16. The method of claim 9, wherein the primary somatic cell or the embryo is from a *bovine* animal.

17. The method of claim 15, wherein the first breed is a Wagyu or Nelore cattle and the second breed is a Belgian Blue cattle.

18. The method of claim 9, wherein the primary somatic cell or the embryo is from a porcine animal.

19. The method of claim 9, wherein the endonuclease is FokI or a portion thereof.

20. The method of claim 9, wherein the second allele has, relative to the first allele, a feature selected from the group consisting of an insertion and a deletion.

21. The method of claim 9, wherein the second allele has, relative to the first allele, a single-nucleotide polymorphism (SNP).

22. The method of claim 9, wherein said introducing of the TALEN comprises introducing a plasmid DNA that is transcribed into an mRNA encoding the TALEN.

* * * * *